United States Patent 12,642,819 (COMPOSITIONS AND METHODS FOR TREATING INFLAMMATORY BOWEL DISEASE) - sequence listing, part 104

SEQ ID NO: 54 - DNA, 3661737 bp, Ruminococcus obeum (residues 1-1,830,869 of 3,661,737)
  modified_base (141715)..(141813): a, c, t, g, unknown or other
  modified_base (928973)..(929070): a, c, t, g, unknown or other
  modified_base (1076408)..(1076505): a, c, t, g, unknown or other
  modified_base (1512281)..(1512378): a, c, t, g, unknown or other
  modified_base (3637628)..(3637676): a, c, t, g, unknown or other
tggaatagcagttccgcagtagcggaactggcattccgtttaagcataatttgcagcatacgcttttggatgatcagatgctttaatatgcatctgtgtgtaatccttgtttgtgttactagccatattatctcctccattcgtaaaaagttcatgtgctcatattccggataacagcgggccagaatacaaaatcagccgatgtaggaatgcccacatcggcttcacattcatgatttaagataatatcactttacattgataaaatcatcggcttgaaatcactttttttcagcaaaatattgtgcacgatgcacatttgtttttaatgtgcatacattttcatttttatagcaaattccagctgttccattatttctgtatcatccaggctgcaatgcaacacttcttcgatcttgttgatacgatgtaccatagtatttctatgcaaaaaaagggattccgcagcaagtttgcgggaattatgattctgaatgagtgcttcaagtgtctcgagcagctgcgtatcatgtgcacggtcatattccactaatgggccaagcttacacctgataaattggtgtacttccgtgtcttcagatatatgcagcataatacgatcatattgaagttcatccaagaaaatacactgccactgctgctttcggatcatgcgaatatgaaaaccttctttaagtttttgataagtatccgccagtttaagataatctgacagagggttgctgataattgcagaacatgcgcaattattaatttcgacagttttttgaatcatatcatttacaattgtatcaaggagtgtatcatttatggatattcccatgagcgcaaagcacatttctttgctacatattacagcatttcgtatatgatttttttcaagaattctggaaattgcttttgtctgttgttcttttttcatttcaagaagaaaagaatttttctcagtttccagagacagcgcaatcatacgcactggttctgatggccattgtaaagaggctgtacgatattctgcctcctctggctgtgtaattttacggttgataagatcaaagaatagtctgttatcaagttctgatttgttttcttttccaatctgataacgagtatccagttcaatattgcttctggattctacgattgctgtcatgacaggaaaaacaagttccacaaagccagcattattatcgagaaaaaataacggaagcttcagttcatccgccagttgaagtgcttctttgggaaaatcatcaaaaaaacgggttttgatggcaagcgcagatgcattcacctcattcatatcgcggatcaggttcagcagagcttctttgtcatttcgaatcacatatccggtagtgatcaggagcaggtgttccctgagccatggtttgatattaggctgttccatcatatcaaatacctctatcctgcgcatgagtccttcctgacctgctaccagggaagcagcaccattattccatatttttacaatatctttaacacgtaatttcatttatatattctcactatcctcctgaagaaacgttattttaaagtgaaatcagaccaaaaagtaatggaatgatgagcatacagaataaagttgttgttactactgccgtggaagcatattcctcatccagatgatactgttccgcaatcatactggaagttgtcatggatggagctgcactgatcaacataagaatcatactttcaacatttgtgagaaaatgatgggaaataaaataaacaatcagtggaatcacgagtaactttgtaaacacaagtacaaggatagatctgtatttaaaaatatttgtgagcttcataaatccaagactgcatcccagataaatcagtccccagctgtaacaggtgtttccaacagaatctatggtgttcatgatcatatcaggaactggaatgtgaaaactggtcagacataatccaagtatgatagaaatgaaaatcggattcatgatgatttttttccacgggttttctttctgtcctactccattcgtaaataatgtaaatccaagagtccagaccaaagtagtatcaatgaccgaacaaatcgggatataaacattaccgccctgatcgccgaacagagtcatgatcagaggaatcacaagaaatccataattaccgccaacagaacaaccacggtgtacattagatgttgttccgcttaagtggcagattctgcttccaaggatacctcctgctgccatgatgaagtacatgagaatctgtgcaatgaccattttgccataacgggccattgtataaaaggtagtctgattttcccagatcagcgaaattgtcaatgccggcaacacaatcttcaaaaggaaaccggaaatagatggcatggcctcttttttgatcacaccaatgcgtgatgcggtaaagccgataagtacaagtaaaagaaatcctgccattttgggaaggattgctatcatataattcataataatctcctcgagtcatcccctcagccctgtgtcaggatgtttctgtgaactttgcgtctgacaaaatagaaacagattacctgcataagaattgtcagaatccaggacacaggatatgaaatgaaaaggaaagaaagggatctattatgaggaaacaatccaaagatccatacgattcgtgttccaacggtacctatgatagacaaaatcattggtacaccagaatgtcccattccacgaagtgcaccgggaatcagatccatgattccgcaacagaaatacggtacggttgtataggcaagaatttcaatcccacactggataacgtccggatcactggtatacagacgcaacaattcattaccaaaaaaataagctccacatcctaatgtaaaggaaaatgtaaaggataggataatacagtcaagaagcactttgtccatacgttttgttttccgtactccataattctgactggtaaagctcatacaggattgtgtaacagagtttacagatacatacagaaatccaaaaatattatttgctgcagtatatcctgccattgcaatcgaaccaaaagagttcacagaagattgcaataaagcatttgacaggttgatgacggtactctgaataccagccggaatgcccacttgaaaaatttgtttcagataaaagctttttatcgtgagttttgagaatctgagctgatagcttccttctgaacggtaaagacatcgtaataccagaatacaggagatgcactgagaaacaattgttccgatagcaactccggctacacccatgttaaaaacaacgacaaggagcatattcagacctgcattcgcaagaccagatatgatcaaaaagatcaacggacgtttcgtatctcctactgctctcagaatagctgcaccatagttataaagcataaaaaatggcattcccagaaaataaattcgcatatagagtgtggactggtcaataacattatccggagtacccatgatttccaatgcaagccgtgaaaaaagaagtcctacaactgccatgatcataccgcttacgaatgccagggcaatggctgtatgtaccgtttccgacatttctttgttttttcccgaagcataaaaacgtgcagcaagcacattggcaccaagggatattccaataaataagttcgtaaaaacagcaatcagcgcagtcgttgaaccaactgccgcaagtgcttcgcttcctgtaaactgaccgacgacgatgatatccactgcattgaacattaactgcaggattccagaaagcatcaatggcaaagaaaatgaaaccagtttgtccatgatcgtgccgttgcacatatcaatttcatatttgttatttttcaaaactactccccctaagtttttaatactatcaatttccatatgccattatacaggtatgaattttctttttcaagccataagcagaacagaccgacaaaaaaaaccctcacgatacagtttcctgtaaagtgagggtcggtattactctgttgggacacaaatattaggctattttagtttgccttataacaacatcaacttatgcattcttctcagcgattgctgcctgtgctgctgcaagacgagcaatcggtacacggaatggtgagcaggatacatagttaagaccgatcttatggcagaattctacggaagaaggatctccaccgtgctcaccacagatacctacatggaggttcgggttaaccggtcttccaagttcgattgccatcttcatcagtttgccaacgccaacctggtcaagtttagcaaatggatcattctcgaagatcttagcatcatagtatgcgttcaggaatttacctgcatcatcacgagagaagccatatgtcatctgtgtaaggtcgtttgtaccgaagcagaagaagtcagcttctttagcgatttcatcagcagtaagagctgctctcgggatctcgatcatagtaccaacttcatactgaaggtcggaaccagctgctttgatctcagcgtctgcagtttctactacgaatttcttaacatatttaagctctttgatatcgccaacaagcggaatcatgatttccggtttgattgcccaatccggatgagcatttttaactttgattgctgcacggataacagctgttgtctgcatcttagcaatttctggataagtaactgcaagacggcatccacgatggcccatcatcgggttgaattcatggagagaatcaatgattgtcttgatttcttcaacagttttgccctgagcatctgcaagtttcttgatgtcagcttcttctgtaggaacgaactcatgaagcggcggatccaggaaacggatagtaaccgggttaccttccagagcttcaaacagtccttcgaagtctccctgctgatatggaagaacttttgcaagagctttttctctttcttcaactgttgtagagcagatcatttcacggaatgcatcgatacgtccctcaccgaagaacatatgctctgtacggcaaagaccgataccttctgcaccaagctcaactgctttcttagcgtcagccggtgtatctgcatttgtacgaactttcatagttctgtatttgtcagcccaagccatgatacggccgaactcaccagcgattgtagcgtctacagtcggaatgattccgtcgtagatgttacctgttgtaccatcgatggagatgaagtctccttcgtggaattcttttccagccagtgtgaatttcttgttttcttcatccatagcgatatcaccgcatccggatacacagcactcacccataccacgggcaactactgcagcgtgagaagtcataccaccacgaactgtcaggataccctgagcagatttcatacctgtgatatcttctggagatgtctcaagacgaaccagaacaactttttctcctctttctgcccattcaacagcgtcatcagctgtgaatacgatcttaccgcaagcagctcctggagaagctccaagacctttgcccatcggtgtagcggctttcagagcagctgcatcgaactgcggatgaagcagagtgtcaaggttacgtggatcgatcattgctacagcttcttcttctgttctcattccctcatctacaaggtcacaagcgatcttcagagcagcctgagcagttctcttaccattacgtgtctgcagcatgtacagtttaccatgttctacagtgaactccatgtcctgcatatctctgtagtgatcttccagagttttgcaaacctgtttgaactgtacgaatgcttctgggaatttctgttccatttcagtgatatgcataggtgtacgaacaccagcaacaacgtcttcaccctgagcatttgtcaggaattcaccgaacagaccattagctcctgtagcagggtcacgtgtgaaggcaacacctgtaccacagtcatctcccatgttaccgaatgccatcatctgtacgtttacagcggtaccccaggaatatggaatatcgttgtcacgacgataaacgtttgcacgcgggttgtcccaagaacggaatacggctttgatagcacccattaactgttccttcggatcagttgggaaatcagcaccgattttttctttatattcagctttgaactgttctgcaagttctttaaggtcttcagctgtaagttcaacgtcctgtttaacgcctctcttagttttcatttcgtcgatcagctcttcgaaatatttcttaccaacttccataactacgtcagagtacatctgaatgaatcttctgtagcagtcccaagcccaacgtgggttgttggatttttctgcaagagtattaactacttcttcatttaaaccaaggttcaggatagtatccatcataccaggcatggaagctctggcaccagaacgaacggaaacaagcagaggattttctttgtcaccgaatttcttaccggtaactccttccattttagtgattgcttccatgatctgagccatgatctcatcattgatctgtcttccgtcttcatagtactgagtacaagcttctgttgtgattgtgaagccctgcggtacaggaagaccaaggttagtcatttcagcaaggttggcacctttaccacccagaaggtttctcatattagcgttaccttctgtaaacatgtaaacccattttgccattttacattttcctcctaattattttgttcttttcacataaaacctatgttttatacgcacataattattgtatagagtttagtacaaatagtcaaggttaaactgtcaaaaaatggggaaaactttgtaagttttccccaaatcatatattgacttatcgtttcttttttaaattaagtacaagatgtctcggaagaccatttaccatgattggctgataatctccctgaatcagaggactgatataatcaacaaaatcttttgttacataggaggcatctttattcatccagttacgtggaacaactttttcttcatttgctatacggtgtacatcataaataccggtcttagccatataaggatcgtctgaaacacggtcaataacgatcattttgccggtatcaccttcgtcggctgcttttactgctgctccgcctaccataaatgcttcatcaatatctactctggatgccatatgagaagcacttctctgtaacgtagaaagctctacagctcttgtcttacagccacattctgctgcaaggaaatttgcaagataagttgcagttccggccagctgtttatggccaaatgcatcaacataatctccagaacttccaagttcgcatacataacgcccatctgcaagacggattccttcagatactgcaatcacaacagaggattttttcttgaggagatctttgactttgacaaggaatttatcaatatcaaacggaacttccggcagatagataagatctggtccatcacagtcttctgtacgtgcaagtgctgtcgcaccggtcagccatcctgcattacgtcccatgatctccatgatcgtgatcatactcttcttataggtaaggccctgtgcatcacggatgacttctttggtagacgcgccaatgtatttggctgcacttccgaaacctggtgtatgatcagtcaatgcaaggtcattatcaatggtctttggaacaccaaggaatttctgcttctggccggtaagaatcgcataatcagaaagtttctttatggtatccatagaatcgtttccgccaatgtagataaaagcatcaatatccaggcggttcaggatttcaaagattttctcataaattgctttatcttcgtgaatctccggaagtttgaaacgacatgatcccagaaatgccgatggagtacgttttagcaattcgatatcaagctcggaatgaatctgtgtagagagatcgatatattgttcatccagaaggccctggattccgtgaagcatgccatatactttgtcgaaaccacgttcgatagcgttcttgtatactcctgccagactggaatttattacggatgtaggtcctccggactgtcctacaatgatattacgtttttttgccatgctgtcatctccttttgtgcatttatgcattacatataatgtataatattaccaaaagttatttgattagtcaagttattttgtgcaatatgtattgtttaagtttcgtaaatatctatatttatagaaattatgtttatatttgacaaaatatctcggaatataacttgtaattctgcccatttatattcacttcactcatcttcacttcatgaaacaggctatatatgtgttggagattttctctcttatgcttacttcacgaaacaggctatatatgtgttggtattctcctcatgtgagagacttctaatatactagaacagctatcaatatactaaaaacgccatgagaaatgacataactcgcttacgctcaaacaatgtcatttctcacggcaacgtatatttctacctgttaagtatattcacgaagtatctcaggctcgcagaatcctcaacacatatatttcctgtttctgatgcagcatagatttcggtggattggcggcggcggacaaaaccgccgccgccagcgtcatccccggcatagcttcgctgagtcgtttgccatcttagaaatgacgatttccgaagcctgtttgccggtatcatatatatcatacgggtgaatttatatatctctttatttacttagaatgtaaacttatcagcgaaatatgcctcaagttcttcaatcttcacacgaacctgttccatggtgtcacggtcacggacagtgacagctccgtcgttttcggattcaaagtcgtatgtgatgcagaacggtgtaccgatctcatcctgtcttctgtaacgtttaccgatatttccacggtcatcaaattcacagttatatttcttgctgagcttctggaaaatcttttcagcgccctcgttcagcttctttgacagaggaagcacaccaatcttaaccggagccagaaccggatggaaatgaagaactgtacgaacatcattcttttctgcgtccagaacttcttcatcatatgcactgcaaaggaatgcaagtaccatacggtcagcacccagtgatggttcaattacatatgggatatatttctgctttttctcatcatcaaagtatgtcagatcctgtccggatacattctggtgctgagtcaggtcataatctgttctgtctgcgattccccacagttcgccccatccaaatgggaaaaggaattctacatctgtggttgctttactgtagaagctcagttcttctttgtcatgatcacgataacgtacttcatcatccttgagaccaagagagctcagccagtcaagacagaatttcttccagtacgcgaaccattcaaggtctgtatccggttcacagaagaattcaagttccatctgctcaaattcacgtgtacggaaagtgaaattacccggtgtgatctcattacgaaaagatttaccaatctgtccaataccaaatggaatctttttacgggaagttctctggacatttttgaagtttacaaagataccctgtgctgtttctggtcttaaataaactgtattttttgcgtcttccgttacaccctggaaagttttgaacatcaggttaaactgacggatatctgtaaaattatgtttgccgcaggacggacacggaacttcatgttctttgatgaaattcatcatctgttcctgagaccatgcatctacgcttccttcgattgcaatatcatgctcggcgcaaaaatcttcgatcagtttgtccgcacggaaacgctcatgacattctttacagtccatcagcggatcagaaaatccaccaaggtggccggaagcaacccatgtctgtggattcatcaagattgcacagtcaacacctacattgtacggagattcctgaacgaatttctgccaccacgcacgttttacgttatttttcagttcaacaccaagattaccataatcccatgtgtttgccagaccgccgtagatttcggaacctggataaacaaatcctctggctttggccagggcaacaattttttccattgtcttttccatgataattctcctcttcgttttaattcgttacgttttctcatcattataccgcatttcagagatatttcaacttttttatttttgcagactaaattgataaaattattcttatccccaaaagctatttcataacctccagaatctggagacttttgaattttctatcagtatttcttgctgtatagagatgaatgatctgctccagttccagaagtacatccggatcaacacagaaagtatataattttcccagggaagctgttgctatgtatctcatggcatataatgcagaaggggaaatccgtcgggcttctcttttgccccttgcacaggattcacaaaggatcccatgcagttcctgagagaagaaacaactctcttcaccagtaatttcgcagccacatccggcacactgaaataactgtggacacaagccctgttctgtcatcgtacgaagctcataaatacaacggatcagtcgattatccatccgggaattcagaagtgccttcacagttacatagagaagattcatcatctctttttcgtccgtcccctctcgcccgaaataatctgccagttcgaggaaataatagccgtaataaactcctggctgcatagtcgcaagttcaacaaaatgatgagtaaccgaaacctgattcaaattgtaacttgtccgaccttcatacaatgtaaaatttccaaatacaaacggatcagccgcagccataaacggactgttcaaacgtcgggcaccttttgcaaatgccgaaatctttccccgttctcttgtaagaagtacaattcttttgtcatattcacccacaggcatagcagagatcacaactccctgcactgtgatcagatcactcattcatcagctttccttttatcaaatctcttttttatcgtaaccaaagtttttgatcataaagtcactgtcacgccagtccttacgtacttttacccagagcttcaggttaacttttgcatccaacatctgttcgagttcatagcgtgcattgcttccaatctttttgagcatggcaccctgcttaccgataatgattcccttatgagagtcacgctcacagataatcgtagcttcaatatctacaagctgacgtttgcccggtcgttccttcatggtatcaattgcaacggcaattccatgtggaatttccgcatcaagtgcgtgaagcgctttttcacggatgatctctgcggcaatctgtctctgtggctgatctgtcacagtgtcttcatcataaaacatcggaccatatggcagatatttcagaatacatggaataatatcttctgtattctgattacgaagtgcagaacacggaatgatctcatcaaaatcatacagcttacgataagtatcgatggccttcagaatttcatctttatcaaccgtatcgactttattaatcacaagaatgaccggcagatgcaggcccttcaactgttctgcaatatggcgttcacctgcaccaatgaaggttgttggttccacaagccacagaatcacatcaacatccttcagtgtacgttctgctacctgtaccatatattcgccaagtttattcttggctttatggatgcccggtgtatccaggaaaacaatctgaccatcttcgcaggtatagaccgtctggatacggttacgggtagtctgcggtttttttgatgtgattgcaatcttctgaccgatcagatgattcatcaatgtagatttaccaacatttggacggccaatgatcgcagtaaaacctgatttaaaattttctttcatttacgataactcctgtatatttttatatactgttttctttctcaacagctaatcagaggaagaactgtatcaaacagttctttttctttttcaattgccggttcacttccgacaacgcagaccgcatcattgtcaagaattgcctcgatcagtggcgcaagttcctgaatatctgtctcacttgcttttagaatctcatctcgttctttctgtgccatttcttcagtaattccacagaaccacgcacttctggagattgctccctgcatctttggggtacgtggtacatctttgccactgattgtaccaataatgtattttgtcatttccctttcatctgccttaaaagaacgtacatattccggaatgcccttgaatacatccagagtacgtctcagatgtggatcacggtaagaaacaaagaaactctcaccactgcgtttgaacccgctcatacagccatatgcaccgcccttgacacggatattcgtccaaaggtaatcgtagctcagtgcaactttcagaatattcagtgcacctgtatattcataaccttttttgcggaaattacctgtctgagccacatactgtacctgcccggaagttgtgaagccttcgttttcctttacacatgtcatattctgatgctgtacgctgacctcttccttatgcagtgtctgtttcagagcttttacctgcttctgcacatccataagggaatccctttcacctgtatagctgacacacagatattccggtcggagaatttcctgcattagatgagaaagttcttttacaagatcatctttacgttcttcaaattctttgtccagtttttcaataaactggtaatacgcaatacctgccattttgtcctgaaatgcagccattggtgatgtataggaggctgcacgcagtactgctgttgaatggcccgcacttaccagactggactgtgctcttgacttcacctgtgcaatgatctcatgaagacgtttggtgtctttcagactggaggtattaatgatctcacggatcattttaaacagaacatctgtttttggatacatggcttttcctcttacagaaaagaaagcacggaatgcatctacagaatctgcatggtcaaatacttctaccccgcacataataccgcctgtctgtgcattgatctcatttgtcagctccccataggtataatgagctgtatctacatatccaagtacagattttaaaagaccaagatatggtattttttcatctgcaaggtctttcagatcaaacatcagatccagataaccgattccatttgttggaacttcatgatacaggaaaaggcttccatctatatccagagcttcattcgtaaaaggtgtgatttctttacgaatatcttctctcttcaacatcggtatacatttagccgcttccggatcctccggtgtttcctgatactgttccagattcgcagtctttttaacaagttctgttttttcctcttcagatagagaagaaagatatgcgtccagtttgtcttccagtgctttggcttttctggcagtcaggcctctggatggattcaatgtcagaacagaaccgtgaggattatccagaagatatctctgaatcagatcttcaaaataaccctgattctttaattcttttaatttatcaaacacaggaatcaactgaacctgcgcgaatggatgttcatcatcataaagccagttgtccagaatatccagaccgtagatcagtcccttcgggtaagaagaaaagtcagcttctctatagcggaattccatataattgattcctgcttccagtgcttttggatcgattccgttttcgaccgtgtctgtcagaactttgcggataatggaaacaaattcttcttttctgccaggatcagcacctttggcaacaacatcaaaatacgtctgtcggataccatcctcataggaaccatacacatccgatccgattccggcatccagaagtgctttcttaagaggtgctcccggagtacttaagagagcataatccaatatatcaaaagcagtacattttaaagtatccatggcagttcctgtcacaacactgtatgccagatacgaattattttcttcactctcactctctgcaaccggatactccatgaccagatcatgcattttatcaaaaggctgctgttcacggatctccgaatccacatacagactgtcaaacgcagaaagataattccgatcaataaaatcaagttttgctgccatatccatatttccatacaggtaaatataactgttggacggatggtaataagttctgtggaattccaggaactcttcataggacagctccggaatattatccggatcaccaccggactcacaaccataggtgatatccggaaacagggagttcatgatatctctttccagcacatcatcaggagaagaaaatgcccctttcatctcattgtaaacaacaccattataagtcaatggaccttctggcttctccagatggtagctccatccttcctgacggaagatttcttcttttttgtaaatatttggataaaatacagcatccagatacacatgcatcagattctgaaaatcctgatcattgcaacttgctaccggataacaggttttatccggataagtcattgcatttaaaaatgtattcaaagaaccttttaccagttctacaaatggatcttttaaaggaaaatctctggatccgcaaagtacactgtgttccagaatgtgtgcaacaccggtgctgttctttggcggagtacgaaaagcgatgttgaatactttattgtcatcatcgttttcgattaccattattcttgctcctgttttgatgtggcgaagcaggtagcctgttgagcggatatcactcaggttttcttttctgacaagtttatatgcttttaaatcatctaaattcattgttgcctccgtttttgcatagtacatatagtatttcctgatatgccatatttattccggaagtctttctcccgggaactgcagttcatacatttcacgggcagctttcgtcagaaggtccaaatcctcttcaaggccaatctcctgtggaagcaatatggcagtttcataaatgtctctctgcagttttgcttttgcactgtctttttttatcgtgataagtccgcaaagtacactgttgtagtttttgtctttttcacaaagatccatataaaatctgacaagatgctggcactctctgtgaagaagttcttcatgaagagcactttttgcacggatttcccgaaattttacatcatccagttctttgcgtatttccttctgtgctcttccggagccaaatactttgtgacctgcatttcgattaaattccaatgccatccagaatttcagataaccgtcggcaatgcccccttcgtttgtcgttcctttgtaacgtgcttcccagatttctttacggatcttatttgcttcctgatcttctccggatgcaattgcctgctccagcagttccttacgtttttccggttctgtctctctataatactgggcaatgattggtgtatccatatatccttctccttttggtatattatcttttgaaaacaaaaataaataaaaaaccctttttctcttcaatatgcctattatagcaaatcaaaaagaaaaagggtagtcctgttttatattcatcaaagcggacacatcagagaatcagcatggcatccccaaacgaaaagaaacgataccgttcctttactgcctcctcataagctgccatgatatgttcttttcctgccagtgcagataccagcataagaagcgtagattccggaagatgaaaattcgtgatcaatccatcaatcattttgaaatgatatcccggataaataaaaatttctgtccagccacttcctgcctgaaggattccattctcatcagtagctgattccagtgtacgacagctcgtggttccaacagaaatcactcttccgccgtttttctttgtatcattgatcagttttgcctgatcttcttctaccatgtaaaattcagaatgcatatgatgctgttcgacatcatccacctttaccggccggaaggttcccagaccaacatgaagcgtaacatgggcaattttaactcccatatcttccacttgtttcagaagttctcgggtaaagtgcagaccggctgtaggagccgcagctgaaccgtcatttttggcataaacagtctgataacggttcttatcttttaatttatgggtaatgtacggaggaagcggcatttccccaagctgatcgagaatttcttcaaaaataccatcgtaatgaaactggatcagtcgattgccttcatcaacaacatcgatgatctctccttttaaaattccgtctccaaacgtaatctttgctcccggacgtgctttcttgccaggttttacaagacactcccatatatcattttctcttcgtttcagaagaagtatctcgatcacagcacccgtttcttccttatggccatataaacgagccggtataacttttgtatcgttgatgaccaggcaatctcctttatgaagatagtccagaatatctgtaaaatgtctgtgttcaaaagatccatcttgcatggaaaggtgcagaagtctggaggaacttctgtcttccaacggatcctgagcaatcagttctttcggcagatcatagtaaaaatctgatgttttcataaactgctcctttatttatcagaggcctcagtttctgcggccttccattctttcttccactgtcggacctgactccattctttgtttgtcagatctgcttttttcaaaagatccgggcgacgctttgctgtacgcaaaatggactgttcccgtctccatgcttcaatatttgcgtgatgtccggagagaagaactggtggaactttctgtccatgccattcttccgggcggctgtactgaggatattccagaagattttcggcaaaagattcagtttctccggattcctgattacttaaaactcctggaaccattcgcgaaatagaatccatcattaccatggccgggagttctcctccggtaagtacataatctccgatagatacataatcggtaacaatttcatcaagaacacgctcatcaattccttcatagtggccacaaagaaaaacaagatctttctcctttgccagttcctttgccattgtctgatgaaatacttctccctgtggagtaagataaacaacccgcggtcgatatcccagctttttctgaatcgattcatatgcaagatagacaggttctgcctgcatcagcattcccgctcccccgccgtatggataatcatctaccttctgatgtttgttaaatgcataatcacgaatattgatcgcatcaatagaaaggtagcctcctgctatggcacgcccgatgatgctagtatgcattccctgttcgatcatttccggaaaaagtgtcaaaacatgaaaattcatttataaaagccccttcattaaatgtacagtcattgtgtttgtttcaatatccacatcaagaatacattctttgattgcaggaagcaatacctctccatgttcaacggaatctacaatataaacatcatttgctccggtttccatgacattttttaatgttccaaattctgatccgtcttccagaagcactttcattccaagaagatctgctatataatattcatcttcatccagttcctgtgcttcctcacgtggaatccacagatcgcggcccttatatttttcaatatcatttatattatcaattccatcaaatttcaagataacaagatttttgaaaaaacggacattttttatgtccagtcttcgaagttcttttccggtatccagcaatacatactccagatcaaggaatcgctccggttcatctgtggtagggtaaactttgacttcgccacgtacaccgtgtgtcgtggtgatcacgccaacttttaataaatcttccataaaaaactccctttaaaaaaggagctatgtctccacagctccgtttcgttattattgcagaatatctacaatcacctttttgctgctctttgaagaagccgctttaactacagtacggattgcttttgcaattcgtccctgtcttccaatgaccttacccatatcggaaggccctactttcagttcgatgataactgcatcttctttttcgttttcggtgacaaccacctcatccggatgttcaacaagagattttgcaattacttcaactaattctttcatcacatacctcccgcaaaggatttattatttttcgattccagcctctttgaagattcttgcaacaacatctgttggctgagcacctgcagcaagccattttttagcttcttcttcgtttactttgtatgcgcttggctcgatgttcggatcatatgttccaatctcagcgatgcattttccatcacgtttgctgcgggaatctgcaactacgattctataaaaaggtgctttcttctgtcccattcttcttaatctgattttaactgccatttctgttttcctccattatactatcttttatttatattgttttttatttaaaaaggaagcttgaagccgcctctttttcccattttaccgcccatcattccaggcatctgtttcattaatttcttgctctgttcaaactgtttgaccagacgattgacttctgcgatatccacaccggcacctttggcgatacgattcttacgggaaatattcagaattcccggattgcttcgctccttctgtgtcatagaaaggataatcgcctttgttctgtcaagagccttttcatcaatcatgtcttccagatctttcgcttttgcgccaacacctggaagcatattcaggatacttccgattccacccattttattcatctgttccatactggtcagataatcattgaaatcgaaatccatttttttgagttttttctgcatctctgctgcctgatcctggtcaagagctgcctcagccttctcaataagactcattacatctcccattccaagaattctggaagccatgcgttccggataaaactgttcgagatctgaaagtttctcacccattcccacaaaaagaattggttttccggtaactgctttaatggaaagtgcagcaccacctcgggtatcaccatccattttggtaaggatgacaccatcaatgcctactttttcggcaaaagtctttgcaacatttactgcatcctgacctgtcattgcgtcaactgtcaaaatcgtacagtcaacattcacattggctttgatatccgcaagttcctgcatcatatcttcgtccacatgaaggcggccagccgtatcaataagaacaacattctgttggtttgcttttgcatgttcgatcgcagctttggcgatatctacaggattctgtttatctcccatggagaaaacttctactccctgtttctcaccgtttacctgcagctgtgtgatcgcagccggacgatatacgtcacaggcaacgagaagtggtctttttcctttggatttcagcttacctgcaagtttcgcaactgtggtcgtcttacctgcaccctgaagtccagccatcatcaggactgtgatatcattgcctggtttcaaaggaagatcggttgtttcacttcccatcagattaaccagctcttcatttacgatcttgattaccatctgtcctggattcagaccattcatgacatcctgtcctactgcacgttcctgcacagacttggtaaactgtttaacaacccggaagttaacatctgcttcaagaagagccatcttgacctctttcagagcaatcttaacatcctcttctgtcaggcgtcctttgcctctcagctttttgaacacattctgtaatttatcagtcaagctttcaaatgccatgcgttataactcctctaatatcttattggaaatctctgtaatctcaccggcattatatcctactgcaagttccttgatcttctgaacctgtttgcggatacagagaaatttctcaaccagatgaagtctggattcatattcttccagtgtatgattacagcgtttgatcatgtcatgtacgccctgacggctgattcccagatcttctgctacctcactcagggaataatcttccagaacaacgctttcataaacctgctgctgtctctctgtaagcagttccccataaaaatcatataacaatgtctgttcgacaaacttttccatttgtaaccaccttggctatcatacatgatttatatcattgtgtcaagtattttttcttgacagatatatttttatttattgtccgtctttttccggatcttttgcttcaaattcaaagacacatcgatcaaaagcattgatcacatatgtatccatatatttatcgtatcgtttgtgttgtcttccatacgacatatgaacatgaccatgcaggaaaaatttaggatgatatttctcaatcagctgcagaaaaattttaaatccctggtgcggaagatcccgggcatcatttaactgatatgccggggcatgcgtgacaagtatatcaaagcctcttctccacacaagttttggaaaaagtttaaagactcttcgtctcatttcccactctgtatattgatgttctcccggtttatatcgcatggaaccgccaagtcccaagatgcgcactccttcatgcacatatattttatcgtcaatgcagatgcagccttccggtggaatcctttcatatttatcgtcatggtttccatggacatataaaacaggcgctgatgtaaatgtcgccagaaaagaaagatagcggggatcaagatccccacatgatatgataagatcgatcccctccagtttacttttctcgaaataatcccacagatattttgattccacatctgctatggcaagtattttcataaaactgtattatcccttctgactttccacaccggactgtaaagtaaccggttttgcctgttctttaagctcacgtgatttcggaattgttccgatcacattatctgcaagccagtccattgtaataatttcttccggagaaagaattttatccggatccgactgaatcattccattctgtgaataaaggattcctgaaaatggatgatattccccggttgcaatcgcacgtttgagcattgtcagcagcttctgtgtgccaatcggaagattctgcgaatagataacatcgatcacttccgctgacagtccccaccaataattgatggcctttgtttcatctttgttatcatcatatttccatgttccatccatgatcgtcctgatcaactgttcataaaattttccccagtgccacaatggcatagcaagattacgaggtccttctttttctatgtgatacagtccaaaatagcgcgatgcatcttccggaatcaccatatcccgtccggatacaaccgtaacaccttttttgataacattgtccatagcgattccaagatcgacatctttcagcgtagaccattccagatatacctgtgctctcggattaaccattttggcacctaaagcaaatgcattgatattggcaatcgttccaaaaatcgggtagtcagcaatatatgcaagctgaccgttttctgccatagctccggcaatggcccccataagaaatttggcttcatacatccgggcataataagtacgaatatatctgtgagatgtattcaaggaacagttaaggatctttacctccggatgtgcaatagcagcctgtacacttgcctgcacaaattccggtgttgttgtaaagataatattgcatcctttttgaatcgcatcggcaattgctttttccgcaagatcttgcgtaaggttttcatagcattctgtagtaacttcttcagggaacgtctgttccaggtgaagacgaccaagctcatgcgcatacgtccaggcagaagtagccggtgtctttgcgtacagaaaagcaatctttagttttggtgtacttaccggaagcagacggtccaggagagattttttttcactcgtaggattcatcttcagttcaatttcctgatcatgttccagaagtttaaattcttcccagcttttaccaaccagttcctttaattcattaactgttttctggcagatatctttataatcataaatcataagaaatgcaaggaatgcatcccctgttgttatggaaagtttctttccgcctaaggattcatattctgctgcaaaccttgaataaacagaactgaaagtcagtttatcatcatctgaccagatatcctttgccccttttcctactgctttctgaagtctgacaaagcttccaggacgtgaaaaccagatatagttgatctgactcagggcgtaaaaatccacatattcataatagattttattttctttctgttccgtacgctgtggcagaattctggtcacatatcccggaaccgaaaccgcatcaaaatacttcagtacactgacacgcttatttccctcttctacatagaatttgttcatatattcatatgctttgatcggatcgcggataccttcattaatatgactctgacttaaagttgcccacttatatgcaaattctgtgttttctctgagaataggcataaagttcccggcgaatgcattgcttcttccaccgcttttggttccgacgatctggtcgatcggtatctgtacaagtccgagcgggacctccgaataggacccctttgggggcagtatctcatccagaacctgaagtgtaggcagttgccctttcatcattctggcctgataatctctcttaccagctttgcaggcttttatatattcttccattatatatggtgccatggtcctcttcctcactttctgtctgaagcagaaaataacggtttaaaagttacagattcgcacgaatgatctttggtttacatccagcctcttccagtgcctttacaattttctttttatgatctgtaccatatgcttccagtgtaactttaagctctactgcagcataacgattggtacttataaactgattatgatccagcttgataacatttccctgattctcggcaatgatagaagctacacgaacaagttcacccggtttgtccggaatcagcacagataccgtgaaaatacgatctctctgaatcagtccatgctgtaccacagaagacattgtgatcacgtccatattaccaccacttaagatagaaaccactttcttaccggtgaaattcaaatgacggagtgctgctactgtcagaaggcctgaattttcaacgatcattttgtgattttctaccatatcaagaaaagcaacgatcagttcatcatcgtcgatggtaatcacatcgtccaggttttcctgcagatatggaaagatatgttcaccaggagtctgtacagcagtaccgtcggcgattgtatttacatgtggcagagtaactacttcacctttttcaagagatgccttcatacatgccgcaccggacggctctacaccaatgactttaatatgcggattcagaagttttgcaagtgtagatacacctgttgcaagtccgcctcctccgattggaacaagaatataatctacaagaggaagctcctgtacgatttccatagcaatcgtaccctggccggttgctactgccggatcatcaaacggatggataaatgtatacccttctttctcagcaagctccagtgcataagcacatgcctcatcatatacatctcctttcagaattacgtctgcaccgtaactcttggtacgttctactttgatcagaggtgttgttgtcggcataacgatcactgcttttgcaccaaatttatgcgcagcataagcaacaccctgtgcatgatttccagcagatgctgcgatcagaccttttgcacgctcttcttctgtaagcgtgctgatcttatagtatgcaccgcgaaccttataggctcctgtacgctgcatgttttctggcttcagatatactttgtttcccgtgagatctgaaaaataactgcttttgatcagttttgtctcctgagttacctgttttacgatttctgctgcctgttcaaagctctctaatgtaagcatactgtatcctcctgtttattcttctgtgtgtaaatctttttcgtcaatgtcaaacagtgcattaacaaaagcatcggcatcaaatttctgcagatcgtcgattgtttcaccaacaccgatatattttaccggaatatccagttccgactgaatcgcaacagcgattccaccttttgcagttccatccagttttgtaagaatgatgccatttacatttgcgacttctgcaaattgtttggcctgtgccagggcattctgtcctgtagtaccatccagaacgaccagtgtttccagatatgcttccggatattctctttccaggatacggtagatcttacgaagttcttccataagattttttttgttatgcaatcgtccagctgtatcacagatcagcacatctgcatttcttgccttggccgctgcaactgcatcgtatacgatggatgccggatcagcgccttcctgaccaccgatcagatccacacctgcacgatttgcccactgtgcaagctgttctcccgctgctgcacgaaaagtatctgctgcagcaagaataaccttcttaccctgatcctttaattttccagcaagttttccgacagaagtcgtcttccctacaccatttactccgattacaagaattacagatttacggttctcaaattcatattctgtactgtctacacgcatctgttccttaatactgttgatcagaagctgtttgcattccataggatttttgatatgtttctctgccacctgttctttcagatgttctatgattgcagaagtcgcattaatacctatatcacccatgatcagaatttcttccagttcttcataaaaatcttcatcaatactggagtagccactgaaaatagaatcaaagccagccacgatattatcacgtgttttggtcaaaccactgaccagacgtttaaaaaagccttttttttcttctgacatactatgtcctcctcgatagttacattgctgttcactctgttaccagcaacttatttgctcagctggttttctaccagatcaacagatacaagagttgaaacacccttttcctgcatggtgataccatataagcgatccgcagcattcatagtgccacgtctatgcgttattataataaactgtgtatttttcgtcaacttctgtaaatacgatgcaaaacgtccaacatttgaatcatcgagtgcagcctctatctcatccagaagacagaatggagatggtttcaggttctggattgcaaaaagaagagcgatcgcagtcaaagctttttctccaccagaaagctgcatcatattttggagttttttgccaggcggttgagaaatgattcgtattccggcctcaaggatatcttcatcttctgcaagttcaagagttccctttcctccgccgaacagttccttaaatgccttatcaaattctctctggatatcacggaatttctcggtaaactgttttcgcattccttcatccaattccagaataattccttccagcgtttcctcagccttaacgatatcatcgtattgaccggacaggaatgtatgacgttccagaagctctttataatcttcaatcgcatttacattaacagaaccaagtttacggatctcatcctttatgcgtgtaacatccgctttgattgcctgtcggtcggtaagttcttcttttcgatactgaagtgcattgtttggcgtgatctcatattcttcccacatataggaaatctgaccttccctctgctcctcaattttttctgtctgacttctcagacggaagcattctttatccagaagagaagtcttttctgaaagatgatctcttttttcaaaaaatgttttgtggctggcacttcgtttttctttttcttcctgacactgtgctctctggctgccatactgttcttcttttaaaaggcattcctgtgccgcatttttcagctcctggataccttcttcttttttatgtatctcttcacgactctgtacaagattttctgtaatttcctgtgattccttctgaaatgcagcaatctcagaattcagacgactcaggttttcctgcaggaattgattctgctgttcaagagaagattcttccagccggattttttccagttcatgtgtcttctctgtttcttctgccttccattcctccagttctttctgtttggtctcaataaaggtttccagttccttttcgtccttctgcgaatcctccagttctctggcaatgctgctatgatcctgtctgatctcacctgcctgatggcggagttcttcctgttcacgatcaatctgccgatagctgttctgaatttcgccttctttttctttgagctgttcaagattcatctttgcagtattctgttcaacatactgttgacggagtttctgctgaaaatcggcgatcgtatcgcggagcacatttcgcctgctacggttttcacctattgatttctgcgtttcttccagttctttcctgagaattcctacacttctttccagttcttcaatttcacggcgtcttccgagaagattgctgttatttttaaacgcaccaccggtcatggaaccaccgggacttaaagactctccttcaatcgtaaccatacgcagactgtgacgatatttttttccgattgcaattgcatgatcaatattatctacaacaaggacacggcccagaagatacatgaccagttcactgtattctttatctgcatttacaagtgtattggcagtacccacaactcccggttcactcaacacatccctctgattcagtccacctcttccgctgatattagacaaaggaagaaatgtagcacggccaaagcggtttttcttcagaaaaccaatcatacgtttagctgtctgttcattatctgtgacgatattctgaatacttccgcccagtgcagtttcaatcgcaacctcatagtctttctgcacatgaatgatatcagccacaacacctttaataccgggttcacggtttttctgttccattacacgacggatactgtttccatatccatcataacgttctgtaatgtttttaagagattccaggcgggaagcctcacgatggtatgctgtctgaccgatttccatctgagaattctgttttttcaattcatcctgtaacttctgcacctctccgtccagacgtacacattcttcatttgtcgaatggatcacagccgttactgcatcatattgtttctgtgcattaagacgttctttctccagaacctcttcttcgcttttcaggcgaagaattcgctgactgatctctgctttacggatattcagctgctccagcatcgcatcaaaacgttgtacttttcctttggtcgttgcgcggctgttcaaaatctcaatgatctcgtttttgccgtcttctacagcctgtgtacattcttctacgtttgaaacgatgttttccagagcctctgtttcctttgaaagactggcccgaatttctttcagtctgctctgcagttccagtttgtcttctgccagtttttctttttcctgcgttctccggtccagatcttcccctaaagctgtcagacggttctgataatgctcactgttctgttttcccgaagagatctgttcttcaagaacctgcacctggccttcatactgctgtttcagaagcgcattctgctgctgctcttctttcaacgtatcgagcctgtgatttaaatcttccagttcctgttccagacggtcatactctattttggtctgatcatatgctgcctgagcttcatttagttctctctgcgcctgttcaagtttttcttccagttctttcagaagttcaccggttctctgatgatcaagaagaaacagattcacatcaagttctttcaattcctctcttttggccagatatatacgcgctgtttcagactgcttttccaatggtccaagctgtttggtcagctcgcttaaaatatccgttacacggaccagattctgccgctcttcatccagctttttcagagtggtagcttttcttcgtttaaatttgacgattcctgccgcctcatcgaaaagttctcgccgttcttcaggtttaccacttaagattttatcaatctgcccctgtccaatgatggaatacccttctttaccgataccggtatcataaaacatttcctgaatgtctttcagacggcatccactgccattgatcagatattcactttctcccgaacgatacagccgcctcgttacagtaacttcattgtaatctaccggaagtttatgatcactgttatccagcgtaatagatacagaagcaaaacttaatggctttcgattctctgttcctgaaaaaataacgtcctgcatgttaccgcctcgaagctgtttggcgctctgttcaccaagtacccagcggacagcatctccaacattactttttccacttccatttggtccgacaataccggtaattccgttatgaaattcaaagttgattttctgtgcaaaggatttgaagccatatacttcaatattctttaaatacatagttcacctgccagtttttcttttcctcatgtatcacgcataaaatcagaatttcttttcctgaattgcctgatatgctgctgcctgttcggcagctttctttgtatgaccggttccatttccgacaacctgtccattcacctgaacacttaccgtaaattgcttgtcatgatccggtccgctctctccggtcagaatatattctaccggctgaattcctttttcctggactatttcctgcagaattgtcttgctgtcataaaaaagctgtttatgttcaatatcgtttaagataaatttcaggacaaaatcctttgcaggttcaaaaccaccatccagataaatggctccaagaagagcttctgttgcatctgaaacgatagaatccctattacgtccacccgtcatattctcgcctttgccaaggagaagatactgtggaagtccaaactgccgcgcgcagtacgcaaggctaggttcacagaccaggcttgcacgttttttggtcagttccccctccggaacctgtgtgaattttgcataaaggaaatcactgctgatcagttcaagaactgcatcgccaaggaactccagacgttcattacagcccagttttcccaactttttttcatttgcatatgaactgtgtgtcaatgcctgtttcagaagttttttattttgaaatgtatatcctatgatctgttccaattgttccattttatctgccttcttttctgttattccttatctggggccggaaattgcaccggctggattttttccgcaattttttcgttgatcctctgttgtttgaactgtacgcactggaaaattgcatgcttaatttcgatagctttggcacttccatgcgttttgacaacaaggccttttaatccaagaagcggagctccaccatattctgtcgcatcaaaacctttgagtgtctgtttcagcgccggtttgacaagaagtgctcctatcttactttttaaagtactcatcattccgtctttgattttgtgaatcagttcagaactgactccctcataaagtttgagaataacatttccgacaaaagcttcgcatacgataacatccgcataacctgccggaatatctcgtgcctcaatgcttccgataaaattgatcccttctgcttctttgagaagcggaaaagtttccttaaccagagcatttcccttttcttcctctgcaccgttatttacaatcgcaacacgcggatttttgatgccgactacatgttccatataaatagatcccatttttgcaaactgtaccagatgagatggtctggcgtcaacatttgcgccacagtcaatcagaagagaaactcctttagctgtgggaatcaacggagccagaggcggacgttccacacctttgcttctgccaacaagaacctgaccgccgacaaggaccgcacccgtgcttccggaagaaacaaatgcatcggccttctgttcttttaccattttaagtcctacaacgattgaagaatcttttttctttcgaattgcaaaaacaggaggttctgcagtctcaattacttctgttgcatttaccacctggattctgtctgtcggataatcctgatatttcttaagctctgaatgaatcacttcttcctgaccggtaagaatgaccaggatatcttttctttcttttactgcttctacagctgcttttacaggttccaccggtgcgagatcaccacccatggcatctacaacaacttttaccaattctgccatattaatcctcctgtatatctattttaaatccatattgttatcaaaaaagcttcaaactttatcatactaaagaattatcagaaaatcaagagtgttcccacgtcatctatttattattctgagcttcgatctgttctgccaggtcattcagataaacccagcgatccattttttcttccagaagtgcttctgcagtctctttttcctttgtaagttcgttaagtttaccggaatttgtagcattcgccatgatatcattatccagcttttcaattttttcttccaacccagcaatatcatcatcaattgtttcgtattcccgttgttctttataactgaatttcagttttgaagaacgattctgtttccatgtctttacagaagatttttcttcctgaggttcttctatcatgttctttccgacagaagaagcttttatctctacggattcatcaatattcatactttcccgacgtttttttgcttcgagatagtcagtatagccaccttcatattgagtcagatttccctctctgtcaaattcaaagatacggtctgccagattgtccaggaaatatctgtcgtgagaaacagcaatgactattccggcaaaagaatccaggtaatcttccaggatcgtcagtgttggaatatcaatatcattcgtaatctcgtccagcaaaagtacatttggtgctgcagcaagtactttcagaagatataatctttttttctcaccaccggaaagtttttcgattggtgaatactgcatggccggatcaaataaaaactgctcgagaagtttggatgcactgatgagtccgtcctttgtcggaataaattctgctacagctttaatatagtcgatcactctctgactggaattcatgtcttcgatttcctgtgaaaaatagccaatcttaatggtatccccaatttcaacacttccgctgtccggttcaaggatacctgctatgatcttaagtagcgtagatttgccgcagccatttggacctatgattcctagtctctgatttttcagaacaatatagtcaaaatcacgaatacatacccgctcaccaaaacgtttggaaatatgatgcagttcaatcgtctttttgcccattctggtctctacagaatcaatctctacatttttgtcccgcacaggcgctgtggaattcttcatggcctccagacggtccagacgggctctctgctttgtacttcttgcccggcatcctctttttgcccattcgacctccatacgaagaatactctgttttttacgttctgaagccatttccatttcttctcgctgcgctttcatttccagaaaatcagaatattttgcttcgtaagtatagatcttaccatgactgatctccagaatcttatttgttacacggtcaaggaaataacgatcatgtgttaccataataacaacgcctttaaaacgattcagataatcttccagccaggaagccatttcgttgtccagatggttggtcggctcatccaggatcagaacatcagccggattcacgagaacggctgcaagtgccacgcgttttttctgtcctccggaaagatgtgcgatttcctcttcatggtcttcaataccaagtttattaagcaccatatgagcctctgtctcgggattccagctctgttctttctgtccctgtgtcacgtaagaaagaatggttgcaccctctggaaattcaggatgctgcggcagatatgtgatacgaaggccattctgcataaccacctgtccttcatcggtttcctcgaaacctgccagtattcgaagaaacgtggtctttcctgttccattgataccgatgattccaattttgtcaccctgatggatgccgcaggagatatcgtcaaaaatcactttttcgccataagttttactgatatgttccagattcaatacgttcatctatatgctccttactgtaaaatctgttcttccgttttaggaaattttttgaagtaatatataataaataaaactgctgtaattccccaggataccgggtaactcagcatgatcgtcttaattcctgaataaacaggaaataccccaaacatccaggcaattctgatcaggcataccccaccgcaggtcaacagcattggtaccaatactcttcccgcgcctctcagcgctccggacaatattccgatcactacatacataaaatatgacggaagaagaaaatgcatcatgtctgcgccaatgcggacaacattgctgtccgttgtaaacaatctatataacggttctgcaaaaccatacagtgctgcacttaccagaattgcagctccataagacataagtagacatactttgacgctttttcgcattctctgtattttccccgcaccataattctggccgacaaatgttgtgatagcaataccaaacgaattgacaaccatccaataaatagcatcaattttcgcaaatgttccccatgcagcaacggtatctgttcccaggccattcacaaatatctgaatgatcagatttgcaatagtatacatagttgcttccagtgctgctggaattccaatgcgaagtaccgactgcagggatgccatataaaaacgaatctccctgatctttaaccggaataaagaatttccctttattaaaatccacgttaccatgcatgcactgattccctgacaggaaacagtcgcaattgcaactcccattacacccattttaaggaatacaacaagcatgatatcaaaaaaaatattcaagacacaggtcatgatcagcacatacaacggtctcctggaatccccaactgcgcgaagaatagaagctcccatattataaacgatattaaagatcataccgcagaaatagatatgcagatatataacagaatcagccatcaactctgaaggtgtcttcatcgctataagaactttttctgtgatccaaaagccaatcaatcccactatggctcctgtaacgattgcaaaggcatacgctgtatgcaacgtcctgtttagatttttatgatcttttgccccataaaactgtgcaatgatcacggaagcacctgaagtcagtccgacaaaaacttccacgatcagtgtaacgatctgattcactgatccacttaccgcagccaaagcttctttacctacaaaacgaccgacaacaatactgtcggccgtattatacacctgctgaaaaaaagtgcctattacaattggaaaaaagaatattaaaagctgtttccagattaccccttccgtaatctgattcttctgttccatctttccctccaagacatagaatttgattgaaaaaaacagaatcccgaaaaaggattctgtttcattcgttgtgattagtcttcaactttcacgatttctttcttattgtagcttccgcattctttacaaactctgtgaggcatcatcagggcgccgcatttgctgcattttaccagattcggagcactcattttccagtttgcacgtcttttatcacgtctagctttagatgatttgttttttggacatatggacataggttacacctccttaaatttactaaatatatcactgatggccgccatacggggatccttcggttcctctgcacatccacagggtccctcattcagattcttcccacaccggctgcatattcctttgcaatcttctttacaaagaactttcaaaggccaactcatcagtacctcaagatagaccaaccggtccacatccaggtccataccagtgagatagtcattctcatccagattctcaactcgctctttatcagtctgtttcatatccagcttacgatcgatatcgtatgggatagtaacagacacctgctccagacaacggtcacaaggaatgccgacagttaaactgccttttcctgtcagttcaagaactttattgcctgtatttgcaatccgtagttctaccggagatctgtccaatatcggaaactctcccatctgaaatgaaatcttatctaactccacctcagaactgaactgtatgatttttccttcactgtctgtaatatctgataaatgaatctgcatagttctctcctattcacactttatcaattatacataggaggtacccgtttgtcaacgacatttttacttttatttctatatttttccgttacttttttcttttactacttcgctgcgaagaggaatggatgcagttgcgccaggtctggaaactgcaattgcggatgcttttgctgcaagctccagtccgtcctgtacaggcagcccatcaataatagaagaaataaaatatcctgtaaacgtatcacctgcggcggttgtatcaacagcctttactttaaagattccctggcggtagatccccgtttcatcctgatatacagaaccatctccaccgagtgtcagaactacttttgcttttggataaagtgctttcacttttgtgagaattttatctggttctttttcgccggtaatctgaaaaccttcaatctcattcatcaggaagagactgattttcgacagatcacagttttccaatgcattgtcaaaaggagaaggattcaaaatgatcatcatatgtttttcgtatgcacggtcaatgatataatccagttcattgatctcattctgcaaaagaatgatgtctccctcttcaaaagaatccaacacagtatcaacaaactcctttgtcatacttctattggagcctccaaaaagaaggatacagttctgtccattttcatccacctgaataactgtatgtccgcatggtcccgggatctgtctgatgaactctgtattcaccccattttccttacaaacttcgagaagcggttccccgccctctccgatcaggccggcatgatatacaggaatcccggcctttgccagtgcaatagactggttcaggcctttaccaccacaaaagatctgcctgctttttgatgcctgtgtttctccgggaatcaaaatagattccacctggtacacatagtccagattgagagaaccaaaatttaatactttcatgtttcaaacctctaaaaaatatttttcatcaattatatggcagttatatgattcttgcaattattatttattttttaccaccaaaaagagtcggatcatctacaagatcaagcggatagtctccaagatgttttactttaaatccatttgccttatattcttcataattaaatgcatttaattcatcacaggcaagtttatggaattcataaaagtttggccagtattcatatccatctccaagattatggctcagataagcatctgctatatcacagcccattttcggagctacataaaacgcacccatagccaaaacgttgacgccatttccggtaattgcacgaagagcagccggcacgctttctacaacgcctgcagaaacacccgggcatttgcttgctgcaatatggatacccattccggttccgcaaaagatcagagcacgttcaaattcaccttccgagatcatagaacccacgcgaaggccgattctgtgaaacatcagatctgtatctgtgtcctccggtgatctgacaccaacatcagttactgtccatccatattctttcagatgagccactactgcttcttttaacgggtatcccgcaaaatcagcacctacaagaatctgtttgtctttaatcgtcttcatgtcaatacctccttgtatttttaacttttgaatcacatttcctgtgattctgattattttgcaatataatccaggatgttcttaaacaacacatcataatatttccagttgcagaattccggtggtgcccagtgcggtgaacagtcactggagaaaacagcagattttccctctccgtagctgccaaacgcaataaacggatctccgcagactgtggcggcaagttctgcttccggttttatggtgctcttattataaccaagtacaggcggccactctccttcgattcccgcaaatgccggatgatccgggagtgtcacttctgcatggacaccctcacagtgttccatacggtcatcgtatggaagaatttctaccggaaggacatcctgtaccggtgttgcccaccattttccctgagctccaacaccattaaaggtaagatagcccccaatcatcagaaggcctccgccaccaagtacataatctttgagtagctggcagcgattgggaagaattttgcttgctccaaatgtagctgatggaatcagcagcgtgtctgctcccacatctgacagaatgatacaggaatattcattcagctcttccagagtaaatggaaaatgatcatttgcaatatgattcggcatatatacaaattcatagccggctttttcgatcgctttgtcgatccagccaagtcctgtttcatatttagatgataaaaaactgttgaatccttttacttccatcagagtagcactccaggattcaccaacaaaaagtacttttttcatacaggctccttttgtttattttgcatgtttcggtttctggctgacataatcaatcacgagtgcaaggatcagaacagctccccagatcagtgttacataatatgtagatacactcctgaaacggttaatgccggattcaatcatcttcaaaagtacgatagctgtgataacaccggaaatttttcctttaccaccattcgggctgacaccgccgagaacgacgagaaggatagactgcatggtatagtttgttccataatcagctcttgcagatgaataggttgcaagcatcatcaatccgccaagtgcagcacaaatggatgaagtaatatgcgttctgaacagcaggcttgttgtattgattccggaaaattttgcgacatgtgcattcgttccgtaaagacgaagtttagttccgtaagtacaatgctccagcataaaccagataatgattgcgactacgataaataccagaagtcttcgtgggataaaaccaaagagatttcctgaaaagaaatcacagtactgcttcgggaaagaggaaattgcagaaccgtttgtcataaccacacagagacctgttaagagctcatttacaccaagcgttgcaagaatcggcggaactccaagttttgagatcaaaaaggcgttcagacttccaacaacaatacctattacaattgcaatcaggaagatcacaacagaaaaagcaagtggcatagttccgtctgctccaaacaatctggtcagtgtaaataccgtaaggatagaagccatattggctgtaccaactacagaaaggtcaatacctcctgtgatcatgcataacataccgcccagagccataaggccgtattccgggaactgtcccgccatggtaagaaagttcattcctgtataaaattttctggcctgtgtaaatgccatgaagatcagccagactgccatgatgaccaacaggcgggtcacttcttcatttttcttatatatacttttgatcttgttcatcatgcgccctcctttactgctttctttttgcttttagaggttcgggttgactgccatgcggtcagggatactccaatcacgattacaagtcctacgaatacatcactccaggttgtcggaattccaagaaggatcatggagttctgtaccaggatgatcaggaaagtaccaagaatacagcctgtcagtgtaccggcaccaccggtaagagcaacgccgccaagaacgacacctgcgataatgttcatttccattccaagcatattcgtcggatgcatctgctgcatcatgcagacacgacagataccactcgcagatgcaatcatacctataataatatacatgataaattttgttctttttacattaaatccagctgtgtgtgcactctgtggatttccgccgattgcgtaaataccacgtccaaagatcgtataatgcagtacaaaatgcataactgcacatacaagaaccagaataatgaaagtataaggaagaatggaagtcagtccattcgccttattagttgctgtcaggaatgcagcggtaccaaagcttttcattccaggcggaatgacagaaagctgatttgctcttaaagtaccctgcatgatgccctggaagatacttgcggaaccgagagtcacgatcattgcattcagattcagatagccaataaaatatccattgaatgcgccaagtactgcaccaattgcgattgcgatcacaaatgccagaagaacatttccttcgtaattcttgtcaagaaggaactttgttgtggcataggcagaaagagatgccagtgccgggaaagaaacatcgattccacctgcgatcagtgccatgaattctgcgattgcaaaaagtcccggtacgatcatcgcactcagaaggtcaacgatattatttgctgtaaaaaactgtccggaacggatctgtaccacaattccgagaagaattatgataagaaaaatatacggttcatttgactgaaatattttctttacttttttattcatatgaccgcctcctacatcatatcgtcaatgatcatctgttcactgacattttgggtatcatattcggatttgatctttccattcttgataacaagaactctggaacagttctgtataacttccggaagatcatcagaaatgataataacaccaagcccctggttggcaagtcgctgcagaaccatatgaatatcatgtttggaaccgatatccacacctactgtcgggccattcaggatgagcacatccagattacatgcaagccattttgcaagtacgattcgctgctggttacctcctgaaagagttgttgccggattgtttggattttttgtcttgatctccagttctttaacccatttttcaatttcttcatctctcttcttcagatcaaactgtccatttttctttttcagtttgtcaatctcagaaatgatgatgttgtcaccaatcgactgggtaagaaaaaggccttctgacagtcggtcctcaggaacatatccaatactattggcaatagcctctcttgggctggtaagcttaatttcttttccatcttttatgatctgaccggaatccgcaggcttcagaccaaacatagacaggcccaattcagtgcgaccagaatccaaaagtcctgtaattccaagaatctctcctcttcgaaggctgaggttaatatctgaaaaagagccattcagagtaagatgtttcagttcaaaaaccggcttgtcggagacatttttcggaacaaatatattgtcggaaaactctcttcctgtcatgtaataggtgaatttcttatcatccagttcttttgtactgcctgtagcaaccaattcaccatccctgaaaattgtgaatcgatcagaaatttcaaatacctcatccaatttatgactgataaacaggattgcaattccctgttcctttaatttcaaaataattttaaacaatgcgcttacttcttttttggtcagcgctgttgtcggctcatccatgataatcagctttgcatttgacatcaatgcgcggctgattgcgaccatctgtttctgagctaccgtaagtttttctactttttcatccaaatcaacctggaaattaattttggatactgcttcttcagcaatctttcttacatttttccaacttactgttttcttacgtgatgcaagttctgtattaagtgccagattttctgcaactgtcagattagggaaaagtgcaaaatcctgataaataacctgaattccaagattgatcgcatcaatcggggaaatcttatcgattttctgtccgttaaattcaattgttccgccatctctctgatagacaccggatataattttgataatagttgattttccgcaaccattctctccggcaagacagtgtatctcaccaggtaaaatctccaaagatacatctctaagggcatgtacatttccaaaggaaatctttatatgctctgctttcaataaactctgagacatagcttcctcctctccgccttacgacacctgtgattgttcaggtcttttggaaatcaatccgccgggagaaccgacggattgatcattaaagcttataaatttttgtgttgtttagaatccaaaatcatcaacgttgtctgcatcgattgtaatccagccctgtccttcaagaactgtttcagatccttcacggaagttcatttctgtataaccatcaacgttaagatttacaggagcaccaatctcctcacctgcaagtactttgcatgcaaggtcaaccattgcttcaccggattttgcaggatcccacagagtaagggatttgataacaccggatttcagcagttcagcattgtctgccggcattcctgtaccggatgtaaagaatttgtcaacaaggccaagttcctgaatcgcacgtgcaacaccaggtgcatcgaaagaagaagttcccatgatacctttcagatccggatatgttttgatcagttcttttgcaacattatatgcggtatcaccgttatcatcagactctacacgcggattatcttccagaagtgtcatgttcggataatgctctttctggtattcaacggctgcatctgcccattcattatgagaaccatttgtaagggaagctaccattgtcgtataaacgccttcttctcccattgcttcagcaaggttctgcatgatgaaagcaccatagccttcattagagaatgcttcgatatcgtagtctacatttttaagatctgcgccttcatgggtaataactacaatacctgcatcttttgctttctttaatgtagagtccatggattccatatcaactggaactacacagattgcatctacgccctgagcaatcaggtcctcaaccagctgagcctgttttgtagcatcaattgtacctgtatcaatctggtaacagttaactcctgtttcgtcagctacttccttaacgccggtgtccatgcgaacgaaccatggattggtggaatccttcggtacaacagcaatttcccaaccttcgtcagccgcttttttaatagcatcatcagatgcaatatctgcatccgcagcatatactgtagaaactgatccgatcatcccaactgccatagctgcacataaagtcataacgattgcttttttcattttaaattcctccttttaattggcttgtgaaacatttacgcggcatctcatattttatttacccatatgatccgaacacctttctcctcccttctctcgttcagatatttgtaccccaatatactttttatgccgtttgaaacgtttcaatattttctaaaaataattgtatacttatttcagtatacaactattaattttagcaagatcctctcatctttattttctgcggtaattctatactctgatattttccggtcttattgtattctgtaattactgaccataaagttcttccgaataatttctgatcctgttccacagttgtaagtctcggattgacatatcccgatatttcaatattatcataaccgacaatagcaaaatcttccggtatggaatatcccttctcattgatggccctcatcataccaaatgccagataatccgaagttgccagccaggcatccggaagttcttcgcgctttgatgactcaagaatctccatcatataaagataactgtttttcaatttatccagcgaaagatctgggcgggaataaatatttttttccggatccggatattcaaaatatttcattgcttccagaaatccctctactctttcacggatattttgaagttttgtaggttctgtaaaaagtcctattcgtttgtaatttctgttttttaacagacgtattatttcaaatggtacccgacgattatcaaatataacacttgatgtataacccggtatctctcgcctgtctgccataatcacatgtatttgtttcttcgctagccgtttaatctctgtgagatcatcaaacccattaaaaataatgattgatgtgcctggtttgctgctctccagtgctctcagctgctgcctttctatctctgacgaatattcataaccagagatatgaacggtgtacccagcctcatatgcatcgtgcatcagtgtactgatcgtatttgtataaaaagcactatccagatgcggtgttaaaacatgtatcgctgtgctgtcctttcttcgaagggaactcgccagagtatccgggatataatccaacacatcaattgcctgctgtatccgcgctgccctgtcgtgcgacacacctgccgtaccgtttaaataattcgaaaccgtcccaacagatacacctgcatgttttgccacctgtgtaattgtggctcttttcttcgtagatttatccattcatcatttcctctatacaaagccacatttgaaacgtttcaatatggcatattatacattcataatttaagcatgtcaatataatcgttataaattgcataatcgaaaatctattttcagtacttttctgcaaatattgcacaatatttttgtgtaatagctacaacaaaaggaagtcataatatgaaaatacgcaaaagaaaaggacctgccaacggcaagcccccttcgaagttgttttataacaaattatttaaccagcgctactgtatctctgcagattgcaagttcttcgtttgtaggaataactgcaactttaacttttgaatttggagtagagataacaatttcttcgctaaatgtatcatttgctttgtcatcgatttcaacgccaagatatccgaaataattgcagacatctttacgaagctggcctacattctcaccaataccagctgtaaatacaattgcatctacaccgttcatagctgctacatagccgccaacaaatttagcgataccatagcaaagtacatcataagcattcttagcatcttcgtttccatctgcgatagcagctctgatgtcacgcatatcactgccgactccggacataccctgaagaccggatttcttgttcagcacattcataacacctgcgatgtcaaggttttctttctttgcaatgaattcaacaattgccggatcaatattaccggaacgagttcccataacaacgccctcaagtggtgtaagtcccatagttgtatctacacatttgccgttctgaacagcactgatggaagatccgtttccaagatggcaaacaataactttggagttgtctttgtcaagtccaaggaattctacagcacgtttggatacaaagctgtgtgaggttccgtggaaaccatatcttcttactttgtattttttgtagtattcgatcggaagtccgtacagatatgcttttgcaggcattgtctggtggaaagctgtatcaaatacaccaacctgcggtacacctggcataagctcagagcagacatcaataccgatcaggtttgccgggttatgaagtggtgcaagatcgttacactcttttactgctgcgatcatttcatctgtgatcactgcagaagctgcaaatttttctccaccatgtacgacacgatgtccgattgcatctacttctttcaggctcttgatagcgcctgttttttcgtttgtaagagcatccagtacaaactggatagcttctttgtgtgtaggcattgcacactctgtgatttctttatcaagtccggctttctgataaaccagtcttccgtcgattccgattctctcgcaaagaccctttgccagaacatcctctgtatcagagttgatgagctgatatttcagggaggaacttccgcagttaattaccaatacattcatcttaatattctcctattcaataagtttcaaaatatgtaattcttatttgtcttcagcctggcactgtacagctgtgatagcaacaacaccaacgatatcatctgcagagcatcctctggagaggtcattgactggttttgcgataccctgtgtaacaggtccgtaagcttctgcttttccaagacgctgagcaagtttatatccgatgtttcctgcatcaaggtcagggaatacaagaacgtttgctttacctgcaacttcacttcccggagctttagaagcaccaacgctaggtacgattgctgcgtcaagctggaactctccatccagtttgagttccggatgttcttcttttgcgattcttgtagcttctaccatcttatctacgtccggatgttttgcacttccctttgtagagtgtgaaagcattgcaacgactggttcttcctgaacaagaagctggaaggattctgctgaagatgctgcgattgcagaaagttcttccggagtcggattctggttcagaccagagtcagcaaatacaaatgcaccgtttgcaccatattcgcaatccgggactacgatcaggaagaatgcggatacaagttttgttcccggtttggttttcaggatctgcagacatggacgaagtgtgtctgctgtagaatggcatgcaccggataccataccgtctgcatcacccatttttaccatcattacaccatagtatgggtactgagtatgaaggatttcttttgctttttcaggtgtcataccctttttagctctcagttctacaaatttatcaatgtatgcctgagttctgtcagatgtctcaggatcaacgatggttgctccggagatatcgaatccgccttctgcagctttcttattgatttcttcttcgttaccgatgaggataatcttagcaactccctctttcagaatcttatctgttgcctcgatagttctcatatcctctgtctctggcagtacgatagttttgatgcttttttttgctctttctttgagtaaatcaacaaatcccatgattaaatggctcctttcgttatttcggtcatcagaccgtgtgagcgtctgaaacatgacctcacagctgaattcattatacccccagaatttgtgcatttcaagtagttgacagagagattcttccaaagagtggtattttttaacgtgcaattttatcattttcccatgccggaaatatgctctgaaatgttttgcagtttttctttataaattttccgtcagatgatacaataaaaaataattttaatttgtacaaaggcaggtatttcatatgaatgtaaccggaatcattgcggagtataatccatttcacagaggtcataaataccagataaattactgcagaaaagaactgcaggcagattatgtgatcgtagtcatgagtggcgattatgtgcaaagaggtactcctgctctgctgcccaaacatctgcgtgcagaaatggcacttcgatgcggtgccgatcttgtacttgaaatgccggtgtccgtaagtactgccagtgcagagacatttgccatggccggtgtttccatactggacaatctgcatgtcgttgaccagctctgctttggaagtgaatatggtgaagtttctgcactacaggaacttgctgctgtccttgtaaaagaacccaaagaataccgtgtacttctgaaattttttttgagcgaagggctgtctttccccgctgccagaagccaggcgctgatcgaatatttcaaagatcctcatcattttgagggagacgattttgatggtattctgacgccacttctcaatcaaatcgtacagattttaaatttaccaaacaacatccttggcatcgaatactgtaaagcattgctccgtttagatagttccatccggccggtcactctgaaacggcagggaatgggataccatgaaacgtttccggatcaacagaccgcttcatcatcattaaattttgcttctgcttccgcgatccgaaatgctttaaaatcaggttttggcatcagtgaaattctaggggaacttccggacaatgccgcattggttctggaaactgctgttaataaaaaagagtttctgctggaaaatgatttttctcttctgttacagtattgtctgttaaacgaaactcctgaatcacttatcggctatgctgatatgtcaaaagatttggccaccagaatttacagtcagatcaatcattttgaaaatttcactcagtttactgaacttctgaagacaaaagagctcacttatacaagaattcaacgggcactcctccacacaattctgaaaatcagggaacaaccaaaaggaataccatatgcacgtgtcctgggattcagaaaatcttcttcccctctgcttaaagaaatcaagcagcatacaactatccctgtcatcacgaaagctgccgatgccttgggaattctttcagcagacggacagaaaatatggaatgataatctgagagcttccaatatctacgaaagtattctggctcagaaaacagggcgtccttttgttcatgaatatcaaaaacagctggtccttttatagggccagctgtccttttattctgacagaatcagattttatcttaaatccaaaacattatttcactttgactgctttagctgcagaataagcggagaatacgtctacaccagcttcatttgcttttacggcacgaactttgtagtagtattttttgcctttcttagcagttttatctgtatattttacagtagatccttttgtaatctcagcaatcttagtatatctggaacctttctttgtagaacgataaacaacatatcctgctgcaccatttactttctgccacttcaggtttactttacctttagagctcttgccggatgtaatcttagtcttgccaatcgttgtgttggaaacagatgctgttgctgctgcgctgcatccacttgtgattacatcatcttcatcgtcatcatatttattattatctgatggtttccagttgtatgttgtgccattcttgcatgcaactacatagtaatagtattttacacctgcctgcgggccgtcatgccataaatctgcaaaaaactgcaagaaaaaaagaccttccaacgaatagtcgaaaagtctttctctcacattctgcttaatcataaagcatttaatcggacagcaggatacggtcattatcgagtgctttaccagcgccacttctgaatttctccagaagtccctctactgtcatatttttcttttcttcgcctccgatatcaagcacaatattaccggagtccatcatcaggatacggttaccaagttcaatcgcagactgcatattgtgtgtgatcatcagacaggtaagctgatgttcttctacgatccgtctggtaagattcagaactttttctgctgtgccaggatcaagtgctgctgtatgttcatccaaaagaagaagtttcggcggattcattgtcgccatcagaagtgtcagtgcctgtctctgtccaccggaaagaagccctaccggatggctcatccgttcttcaagaccaatatccagtttcttcaattcttcacgaaagcgttctttttcctgacgagtcgtatgtgaaagccatcctcccttacctgctgcaagcgcaagattttcttcaatcgtcatgcccggtgcagttccacgcatcggatcctgataaagccgtccaatgcttcttgcccgtgcatgctgcggcataaatgtgatatctttgttatccagttcgatcgagcctgtatcggtcagaaaatctccgcagattgcattgaataacgtggactttccagcgccattggagccaatgatcgttgcaaaatctccctgtttcagttccagagataaatcctcaattgcttttttctcgtttactgttcccggattaaatgtcttggaaatatggctgatttttaacatgaatcatctgcctccttttgtatgtgtcattcttcttcgaatctgtggccactgtttcttaagatatggaccagatattgcaagaacaacaatgacagaggataccagtttcaacataaatgccggcatattaaaccgaagtgcaatcgtatatacaaggcggaagataaatgaaccaagaaccattcccactgctcttacaaagattccaccacgtcccagaatcgtacctccgatcagcagagatgccagtgcaatcgttaccataccctggccaatattgatatctacagatttctgtgactgggacaaaagacatccggaaagtgctgtaaatgcatttgctacgcaaagaccaattaccgttgtaaacaccggattgatcgaagatgattttaccatatctgaattatttccagttgccctgattgcaagaccaagtcttgttttcaggaaaaataccagaaatatgatcacgaggatcactgcgatcgctgcaataatgatatcttctcttcctttcagcggagtgcctgcaagtgtatctttcatcatggtaaacacggtggtcgtccggttcatattaataagagaagaacctcccatcactgcaatattcaccgaatacagtgcagtatttacgataatacctgcaagcagactatctacaccgagctttgtctgcaggatcgccgttacaaatcctgatataatacctgccgccatagcagctataatagacagaaaaggatgcccgctcacagctactacggctcctacagcagcgccaaaagtaaagcagccgtctgtagaaagatcgcagacattcagcatagaataactaagaaacagagcaagaactgtcaaagaacagatcagtccaagcttcagagcagtctctccaagggagagcatagttgcaatcgtcacagtaaattcctccagttaatgtttattttgcttctacatcatcaaagctttcagcagttgtgatttcatttacctgtgtgcagagaggctcaaatgctttctttacagtatcaaaatcaagaccgagagcttcacatgtttctgtgtttactgttgcagtaccattgtcaaatgtttcaactgcagtttctgatggtattgctccatctaccagaatatcagcaatcatatcagctgttttctgtccaagattcgcatagtcaacaccatatcccacaaatgctccgttcaacgcaaaggagtcagctcctgtatagtgcggaattccggcttcgatgaatttctcataaatagaaagttctgctgtcatgatagtattgtcagtaggtgtaaatacggcatctacgccatcagcaatcagtgcttctgctgcaagctgtacttcgtctgttgtcgttccggtacgctctacatattcaattccctgttcatccaggtaatcttttgcttcctggatcgctgttgtagaagaatcctgtccgacatcatagagaagaccgattttttttacatccgggttctgtgcctggatcagtttcataatagaagaagtgtccagataatcactggttcctgtgatgtttgctccaggagcttccagagaatccacaagtccggaaccaaccggatcagatactgcggagaaaacaaccggtgtgtcggttccttctgttgcagactgcatacgcattgccaccggtgtagccacgcctaccatcagatctacattgtcagcttgaaaatcagagatgatctgttccataacgctggcatctgcattacagttatcataagatacgtcaaatgtaacccctttttcttcaccgatttcttccaggcgggactgaatattatctacaatctgatttaaagaagcatcatccacataattacagatacctactttaaaatcatctgccattaccggacaggtcatcatcatagttgctgttactgctgctgcgattactaacattctttttttcatagtctttttcctctcttttctgcattttatgtgtttctacatttcatgttccatgagaaaaaaagaaccgtcccaagctatgcttgagacggtaataatttcttattatcgcggtgccactcaaattgacgtatcgtccactttctcatgtacaaacatacactcctgattgataacgggttcggttcccgtcagcgcctactcttcagattaaaatttcgggctgccctcggaaggccattcaataatctgtttcatacaggcttacaccaacacctgctctctggaatgatacgaaattatttactcttcttcctcatcggttttgttattttatactttaccacaggaaatcgttgctgtcaatcattttttagaaaagtatccgctggtttctgaaaactcaatgccagggaaagaggatctatgaaaccattcttcgctaatatagaaggatcatatttccacagctgcacttctgcctgtgtttctgcattcagaagttctttacttcccgatagatgaaatgtttttttattcactgcatagcacggaacttcttcttccgcgtcttttccgatatggataagtgccgaattgcccgaaaggaaacgctctgaaatatctgttccctcttccagttcctttttacttataaatacagtttctgctacaggagtactcaaagcatcttccagctgctgcaggatcacatttcgttcttctgttcctttcagatatttctgcacaccggttttgccggtttcaaacaaaccagtctcctccagctggcgaaacgcacgcgttacagtcatcgctgaacagccaagtatttttaccatatcattcatgtaaagacaattttcctgctgataataccagtagaagagcagtagctgtgtaaagggctgaaacgtatccgaagtcttgatttcctttatatatttttcctgaagatatattcccataaacggcagataaagctggattcctactacaataaaaggaagatgtgcatgaataaaagcatctctgtgataacaatccatcttatcaaaaacaaacacaaccggcagtgattcctccatctgaattcgccggatctgctttttaagcgaaccaatctgattcagctttttcttcgggctgagaaaaatacagcgaatatcatcaagctccgcaagtcgcatatcgtagcgctctgtaatataaaacggcagttccagttcacctttccagtggtgaaactgcaccgatattcccagtattttttctatatagctttttatttgttcattcattttcttattagtgaagtctcctttatatcctttaaaatcaatatataacattatttttcatttttatcatatattatgttataacataattattatgttaaataaagtattttcagtaatcttctaactttcaataaaaaaacgtttagaattacatcaaaggataataagacaaaaaaatccccggggctctgcttctccccagggaaatacgttttaaaatcagttcttaaagctatggattggtgccggaatacgtccgccacgttctacaaatgcattacaggagaactgattcactggcatgatcggtgcatatcccagcagtccgccaaactctactgtctcgcctactcccttaccaattacaggaatcagtctgacagctgttgtcttctgattgatcataccgattgcagattcatctgcaataattcctgcaatagtagatgcttttgtgtcacccggtatagcaatcatgtcaagtcctacagagcagacacaagtcatagcttccagtttttccagtgtcagcgcaccaagatttaccgaatcaatcattccctggtcttcactgaccggaataaatgcaccgcttaaacctccaactgcctgtgccgccataacaccgccttttttaacctgatcattcaaaagcgcaagtgctgcagttgttcctggtgctcctactctttcaagcccgatttcttcaaggatctctgctacgctgtcgccaattgccggtgtcggtgcaagagagagatcaacaattccaaacggtacacccagacgtttagatgcttcctgtgccaccagctgacctacacgggtaactttaaatgctgtacgtttaatcatttcacataaagtctggaaatcagcaccccgtacggattccagagctgtttttacaactcccggaccacttacgcctacattaataatgcagtcagcttctgtaactccatggaaagcaccagccataaacgggttatcatctggcgcattacagaacacaacaagtttcgcacatccaagggaatcctgttctttggatgcctctgcagtttccaggacgatctcacccatcagcttcaccgcatccatattaatacctgtcttggtagaaccaacatttacagagctgcagacacgttctgttactgccagagcctgtggaatggaacggatcaaaagttcttctgccggagtcatccccttgctgacaagggctgaataacctccaataaaatttacaccaatagtctttgctgccttatccaaagtctttgcaacagagacaaaatcttctgtagaatggcatgcagctccaccaaccagtgcaattggtgtgacagaaactcgtttatttacaaccggaataccaaattctgctgcaatctcatcacctgtagcaaccagatcttttgctttcgttgtaatcttattgtagattttttcattcatagtatccaggtcactgtcaatgcagtccagaaggctgattcccatggtaatggtacgcacatccagattttcctgctcaatcattttgtttgtctcattaacttcaaaaatattaatcatgtcaactctccttttcggtaagatacgattaaatacgatgcattacattgaagatatcttcgtgctgacagcggatcactacgccgatcttatcgccgatttcagaaagttctttagagagagccgcggcatctttgtcagatttactggtatctgcaaccatcatcatgttaaaatacccctgtacgatagtctgggaaatatccagaatgtttacattgttgtctgcaagatatgtacatacttttgcaataattcctacggtgtcatttcctactactgtaatgattgtttttttcatgacttttttcctttctgttatacggtaactacatccgaaacaaagtcccgtttcgccacctgaattctgaaatcttttgatttgtaagggttgtctcccagtgttacctctgaacaaacagtttcataagccagttcttcatagttgttttctctgcttagatgtcccagaaaaattgctttcagattatcatgcagcagcctgcacaacaatctgcctgcattttcattggacaaatgccctctgtctcccagaatacgctgtttcagataatatggatatttacccacctgcaacatacgaatatcatgatttgcttccagaagaagcgcatccagtccctgcagattctcaataatataatcattatattttccaagatccgtcgcaattcccacagaatgtccctcatgttccagccgataaccaaccggctgagccgcatcatgtggaatcgtaaatgggtttaccttcagatcattgatcataaatggttcgtcttcctgaatttcatgaaaaatcccctcaggaatctttccaagtgcattggtacgcaccatggcatctatggttccagcggtagcatagattggaatgccgtattttcttgagatcacgccaagccctttaatatgatccgaatgttcatgtgtgatcaaaatgccatcaaggtcacgtccggtaagctccagactattcaagccagtttccattttcttaccgctgattccgatatctaccagtacatgtgtattgtcagatcctacataaatacagtttccgctgctgccactggcaatactgcaaaatctcataataatttaatcccctcttctatttgtttccaggttgtcttcagatctccattatttataataacataatccgaatgtttcctgaaaaattcttcagaaccctgtcgggcgatgatactctcagctttttctcttgtatagccacggctgtccatcaaacgctgaatacggatttctgcatccgtatgaatataccagacattgttacaaaattcctcataatgttcttccagaagaagtgctgcctctatcacaagcaatctgcaacctgcctgtctctgttttcggatttcctctaaaatatatgttttgacagcaggatgaataatagcatcaagactttgacgcattaactcattaccaaatactacatcagaaacctgctttcggtcaatagttttatcgttttttattatttgtctgccaaataatgcaattacatgctcatagcagagtccacctggttccataaccagatgtccaatcttatctgcctgaatcacatacgcatcatatttctgacttaaataatccagaatcgtacttttgccggcgcccacaccgccggtaattcctatgattttcatttgttacgcctcattattttgcttcataccagctgtttccttcatgcatatcgacatccagttctacagaaagatgtacagctcccttcatttcctcttcaaggatgcgggatactgtttccacttcctccttctttgtttcgatcagaagctcatcatgcacctgaagaaccagtctggactgcagcccttcttcttttagacgctgatatacccgattcatcgcgattttgataatatcagcggctgtgccctgaatcggcgaattcatcgccacacgctctccaaaagatctctgcataaagttaccggatttcagttccggaatcggtctgcggcgtccaagcattgtagaaacataccctttttcttttccatccgctacaagtccatcaagaaatcctttgatctttggataagtttcaaaatatttttcgatatattcagcagcttcttttcgtgtgatactcagatcctgactcaggccaaaagagctgatgccatacacgattccgaagttaactgctttggcatttcttcgctgcagatctgtaacctcatcaaacggtacatgaaatacttgtgatgcagtcagtctgtggatatcttccgcctctctgtatgcctgaatcagtttctcatcgcctgacatatgtgccaacacacgaagttcgatctgtgaataatctgcatccagaaatacatacccatcttccggcacaaaaactttgcggatcagacgtccaagctccatacgcactggaatattctgcaggttcggttctgtgctgctgatacgcccggtcgctgtaatcgtctgattaaaagtagaatgaattctgccatccgcttcaatcactgcacttaggccatctgcataagtagatttcagcttggtaagctgtctgtattccagaatatcattaacgattggctgctctggcgcaagtttttccaaaatatcagcagctgtagaatagcccgtctttgtttttcttccaccagggatactcattttttcaaaaagaatcacgccaagttgtttgggagaattgatattaaactcttctccagcctgttcgtagatcagcttttcaagttctgcgatacgaacttggagtttctctccataagatttaagttcctcgcctttgacacgaatcccccatttttccatagaatccagtgtaaagattaatggaagttcaatttctctgtaaacattccacatttctgtttcttttaaggcattttcaatcggttctctggttgcatatgccgtataagccaaatgacacgcataagacatcaatccatcagaggatttttcccaggctgcctttagagaatctttgccgagcagatccgttcgcgtcggaagtaaggctccatcaagatattctcttgcaatatcgtcaaatgtataagaagattttaatggattcagaagatatactgccacacctgtatcaaatacatggtctgcatcctcgagtccaacgtgtttcaacatagattttacatctatggaacagagaattgtactgtcagcgatttccttcaatgctgcacaaatataatcaccggtaagcaatccctcaaccggaacataataaatttctcctttggtaagagctattccaaggccatatacgccttctttatcagaaagcaatgccacaccgatataatttttctcagcagctttcttaaacagtgcttctgcgcctccaagatcactgcaggtaaaaaaattctgctcaatcgtgttctccggtacagctgaagtatcaaatcttccaagaagatttttaaattccagctgtttacagagctgatacgcttccggagtataaagattcccaagtctcgcctcttcatatacatattccagcggactttctgtattgatcgtagcaagtgccttgctaagttctgcaagatcataatgctctctcaacgattcccgggctttatttggttttatttcttccagatgtacataggcattttcaattgttccaaactcaacgatcattttggttgccgtcttttcaccaacgcctggaattcccggaatattatctgccgaatctcccatcaaagcctttaattctataatctgtggcggtgttacctgatatttttcaaggacttctgctgcatgaaaattttcgatagttgtctttcctcttgaggtttttggcagacgaatcataactttttctgttgccagctgaagaagatctctatcacctgacaggattgtaacatccattccttctttttcacttctgacagccagagttcccaaaaggtcatctgcctcatatcctgcttttgaaacaatttttattcccattgccgtaagcatttccttcatcaacggaacctgctctctaagttcctccggcattggtttacgtgttcccttatatgcttcgtacatcttatggcggaaggtaggctcatgaagatcaaaagcaactgtcagatactgcggtttctcctcctccaggatacgaaaaaggatatttaaaaagccataaaccgcacctgtatgttttccctctgcattggtcagatccggaagtccataaaaagcgcggttcagaatactgtgtccgtctatcaataatatcttttcactcaaaataatatcctcctgtatcatgttataaaaagtgcgttacttccattacaagaaatacaacaaatgatgcagccgcgatcactactgccataaaaaaaatcacagacaaaaaatgtagccatcttttctggcggatatatctgcgtgatcgacggatatcctgttccagaagttcccgaaaatcaaggaccgtaccatcttccttctcatccagctgctgaattgcctcatgaacgataaaatatgtctccaactcatcataacaggaagaacaatgctctatatgatccagaaattcttccagttcgtctgtggacaatgtatgcttgatatatctggcaaccagtgtttctgcctgtctgcagtcaatacctgacaacgttcttcctccttttttcaatatcatattactgaaaagattataatttcactgttttgtagtataacacaaaaagagacgtttcacaatgagaaacgtctctttcgtacagctgctgttcatagtaattcacatggcaatattatatcttatcggtttcctcttcggaagttttcaaagtatcttctaccactggtgtaggagtttcgagaatcttcataaattcttctccggtaatcgtctcatgctcatacagatactgcgcaagttcatggagtttgccgatattatcctgaagaatcttcagcgctttttcatgctgtttgcgaacaagttccacaacttttttatccagcattgtctgtgtttcaaaagagcatgtcaggctggaatcaccacccagatattgattgctgacactttccatcgcaaccatatcaaaatcatcactcatgccataacgcgagatcatggctctggcaatctttgttgcctgctcaatgtcattggaagcacctgttgtgatcgaatgaaaaatcagttcctctgcagcacgaccgcccgtaaatgttgctatcttattttccagttcttctttactcatcagataatgttctccatcatctacctgcatcgtatatccaagagcaccggaagtacgtggtataatcgtaattttgtgtaccggtgcagattctgtctgtttagctgctaccaaagcgtgtccgatttcatgataagatacgatcagtttttctttattagaaagaacacggtttttcttttgatatccggcaattacaacttcaatactttcttcaaaatctgcctgtgtggcaaatttacgtccatcacgtactgcacgaagcgccgcttcattgacaatattggcaagttcagctccggaagcgccggcagcagccttcgctatatcatcaaaacgaacggtatctgcaatcttgattttctttgcatgtaccttcaaaatctcctcacgaccctgaagatccggaagttctaccggaattcgtctgtcaaaacgtcccggacgaagaagtgcagggtcaagagaatccggacggtttgttgccgcaagaattaccacgcctttggatccatcaaagccatccatttctgtaaggagctgattcaaagtctgttcacgttcatcattgccacctgtaaatccagctccatcacgtttcttaccaattgtatcaatctcatcaataaatacaatacatggtgctttttcatttgcctgtttaaaaagatcacgtactttggccgcgcccataccaacaaacatttctacaaactcagatcccgaaatagagaaaaacggaacttcagcttcacctgcaactgccttggcaagaagagtcttacctgttccaggaggacccacaagcagtgcaccctttggcatagacgccccaatttctgtatacttctgcggattatgcaaataatcaacgatctccgtcagaagatcttttgcctcatcttcacctgcaacatcagaaaatttaattcctgtagaagatttcacgtataccttggcattacttttgccaaaagacattgccccaccagggccgccacccatagatgacattatcttcttactcagccagcgaccaataaaaataaagatcacgattggtactacatagctgagaagcagtgtcatcagtatagaaggactttccggaagaacttcatccattgttacccctgcatccaacaggcgattaaccagatcagagtcatccatcttgacagttttacacagaaccatattcccggaattactgtctttcatctcataatatatataattttcttctactgtagcctttgttacattcccatcttcaacattttcaataaacgtagaatagtccgtcttctgcacgcttcgttcctgtacggccggaacaaccagcatattcagaagaacgatgataacacctgcaatgatataatatacatacataggtattttctctggttttttgttcccaaacttcatttatcttttgtcctccaaatcttcgaaagtcccggtatttagtatctccggattctttcaaaatcatttatgtcatgtaccatatcatttttctttccaagattcaatgtccattctatgaaattttataaacttttcataaaaaagctacaatgttgataatcaaaaaagctctctgattatcagagagcctgagttaagtgccgctggccggactcgaaccggcacggtttcccgcttgattttgagtcaagtgcgtctgccaattccgccacagcggcaaatgaaccgaaaattataatatcataattctcagtccattgcaagcattttagatagaaatacaaatatttttatttgtttttatttataaagtctgtcttcatcttcaagcattttttcataaatcgggaaacagtcaaatgtcgcaaaataatctcttggagtttccgcacgacggatcatatcaaaagttccatcctcatgaagaagaatttctgcagatttcagtttgccattgtagttatatcccatggcaaatccatgtgcacctgtatcatggataacaagaagatctcccatatcaatctttggaagataacggtcaattgcaaatttatcattattctcacaaagagaacctgtaatatcataaagatgatcacatggctgatcttccttgcccataactgtaatatgatgataagctccatacattgccggacgcataaggtttaccgcacatgcatctacaccgatgtattctttgtgtgtatgtttctcatgaattgcttttgtaacaaggcatccataaggtcccatcatgaaacgcccaagttccgtatagatagcaacatctcccattcctgccggaacaagaacctcttcgtatactttacgaacgccctctccaatcacacgaatgtcattcggtgtctggtccggtctgtatggaataccgattccaccggaaaggttaataaatccgatatgtgctcctgtttctttctgaagctttactgcaagttcaaacatgactttggcgagcatcggataatattcattcgttactgtattgctggcaagaaatgcatgaataccgaaattctctgctccttttgctttcagagtgcgaaatgcttcaaaaatctgctccgttgtcattccatatttagcatctcccgggttatccataatatcattgctgattttaaagactccgcctggattataacggcaactgatcgtcttcggaatatatccgaccgctttttcaactgctttaatatgggtaatatcatccagattgataatgccaccgatttcatttgcataacggaattctgcttctggtgtatcattagaagaaaacatgatatcaccttttttgcagccgattgctttggacagcatcagttctgtcatagaagaacagtcacatccacagccatattcctgaagaatctgaatcaaatacggattcggagttgcttttactgcaaaaaattctttaaatcctttattccatgcaaaagcttctttcaatgcttttgcattttcgcgaattcctttttcgtcataaagatgaaaaggtgtcggatatttttcagtgatttcctgaagcttttccaaagttacaaacggcttttttttcatatttttatctcctcgttatattggcattatttcacatgctggtgtgtaaacagatgatcctggcagtactcataattaccattgcatttggaacagaaacgaaattccagattcggatcatccttctctgtacgaccacaaattgcacatttatgtttggtaatgccacctgttgccggatttactctgctctgtgccattgccttcttaaactctctacgtcggtgtacctctttaggattataccgatgcatgtttctgttactgaaaaagaacagaacaaaattcaagagagatgcaaggatcggaacagccataacccacagaccaactcttacatatgaaatcatattataaacaatgatcgcgccatatacccatgccatccatttcattttgatcgggatcacaaaccacagaaggatctgcatatccggatagcatgccgcataagcaagaaatacagaaagactgacataataggtcgtaaaaacacttccaccgatcatataagtcattccatcgatcacaacaaaaccacctgtcacaaaataagtgataaacgctgcgatcaaaacaaagagaagcccggaaaatatatacaatgtataccggaagcttccccaggtacgctcaagagaggtaccgatcggataataaaagaacagaatagaaatcgcaaacaataggaaattaccggtgcttggtggatagatcacccaggtgaccagacgccagatctgtccctgcagaatcttggaaacatccagactcatcatactgagcagcgatggattcatataagtgagcaaataccctatcacataacagataataatatacactgtcagattcggtattccaccatgtcttccaaatttgcgttccagtttatcgatccaattcataaaatcacttcttctcctttttcagttaataagtactgttcggaaagatgaatacctgccttatcaaaaatatttcttttttgacaggaaaagtgctgcaatgatactggccgcaatagagaccagaattacgatcagaaatccccaaatcgtaccggagaaaggcattccggacggtgccaggttcattccatatgcactaaagatgatcgtcggaatactcataacaatcgtgatcacagacaaaattttcataacatcattcaggttattggatataacagatgcaaacgcatccatcatactctgcaggataccgctgtatatattcgccatctcaatcgcctgtgtattctcaatgataacatcttcaagaagttctgtatcttcaggatatttcttaatgctctccagcttgatcagcttctcgagcaccgcttcatttgatctcagtgaagtagtaaaatacaccagagatttttccagttccaaaagctcgatcagttcctgatttcgcggagaaaaatgaagtttttcctcaacctgttcacttttcttgtcaataatacgcagataacgcagatacatgctggaattacgatacagtatctgaagaataaaacgtgtcttcatataagtaaagaaattacgcacacgtccctccataaatctggtaagaacctgtgtatcttccagacataccgtaaaaatcatcttatctgtgactataatacccagcggaatcgtaccataccagtccttgtcatttcgttcctcgatcataggaacatcaaccaggatcagagtgtaattatcctccacctcaatacgtgaccgttcctcctcatccagaggagctctcagatcatcgacctctatctgaaactgctcggatatctcaaagatttctgttgccgtaggatttgtaagggcaacccagcagccatcctgaggttcctgaatttcatgaattgctccgtctgatgtacgaaacatcctaaccacgattacactccccttccactctcattttaggtcatatggatatattataaaatgtgacaggatttttgtcaattccaacggaattgtattcacaaaaaatttactcaatttatgttttaaagtggtatagtgtaaattgtagactttctttatttaatatgttaagatggactacagtaataagggaggactcaataagacttatgaataaatccagctttggtacacatttcactgtaactacctggggggaatctcatggaaaagcgcttggtgctgttgtggacggctgcccggcaggactttctctctgtgaagaagacatccaaaaatttctcgacagacgcaagcccggtcagagccgctacacaactgcacgtaaagagggcgatcttgtcgaaatcctttccggcatttttgagggaaaaactaccggtaccccaatttcattaatagtccgcaacactgaccagcgttccagagattacggcaatattgcgctttcctatcgtcccggacacgcagattatacttttgatgccaaatacggttttcgtgattatcgaggcggcggccgctcttccggtcgggaaactatcgggcgtgtggcatcaggtgcaattgcctccaaaattctggaaactttagggatttctttctgtacttatacaaaatccatcggacctgtttccatcaaaaaatttgattcagaagaaatcaacaataatgcattttatatgccagatgcggatgccgctgccagggcaggtacatatctggagaaatgtatgaaaagccaggacagtgccggtggtgttgtagagtgtcgtatcacaggtgtcccagcaggtcttggaagccctgtcttcgaaaaacttgatgcagtacttgcccaggcagttatgtctgtcggtgctgttaaagctgtcgaaatcggtgacggtacagaagttgcacatatgaacggttccgatgataatgatggatttcattttgaaaacgggcaaatcagcaaaacaagcaatcacgccggtggcatcatgggtggtatcagtgatggaagcgagatcattctccgtgcttatatcaaaccaaccccttccattagccagccacaggaaacaactacatgcaacggcaaaaatatttctcttgaaattcatggacgtcacgatccagtcatcgtaccaagggcagttgtcgttattgaatctatgtgtgcgcttgcaattacagatgcactttttgccaatatgacttcccgtctggactatattcagaaattttacacaaaataactcagacagagtcgcttctataacgcaaaaaagatcctgcagtcataactgcgggatctttacatttacaaatatatatgagaaaaatcactcctgctcagcttctgcatcagctaaaggttcaacagcatcaaagtcctgtggtaccggccacatatgaatactgtttggagtttcaattttatgtggtttatcattcatcacaataatattcttctcataatccactttgaatgttgtgattgtattacttgcatggttcgcaacagcaatatgctgattgtcagggaagattactatatccttcggataatcaccgctgatcggcagagtgaactttttctccagaagtccggtttctgcatcaatctcatacatggagactgtgttttcaccagctgttgtgcagaaaagatgtttgccatcaggagcaagtgccagaccggaagccgcattgtgaatcgcatccttgtcatgttgcttactcaatgtagaaacactctgcagaagttcaaattccggattgtttccacttccatcataactgtaaactttaatctcattacttaattcaaacagaatatatgcatactttccatcagcactgaaacgaatgattcttggtccactctctctcgggcagcgaagaatatctactaattccagtttatggcgtcttttgttgatccgatagatcttaacctgatcaattccattgtcaactgcacaaagatatttattatccggtgtcggacgtacacagtttacatgtggacggaagttacgctctgcgacacttccaagtcctttatgaaatacaccatccataatacggccaagacttccatctttatgtgtatgtacaaccgttactttgccatcgtgatatcccgcaacataaagataacgaccgtccacatctgtagcaaggaaacagcctctcatgccgtcaattcctacactattaattcgaacaaggtctccgttctcgtcacgtttgaataccgcaacaccctcgtcctcaatagaatacagatacttaccgtttttggaaactgctgtgtgagatgcattgctgacgttaacttcgcttcgttcgatcagtttaccattctctacatctacatcataaacctgaatgcccttactggtaccataagtgtatgtacccacataggccacatatttcttgttccccattatactgcctcctaaaattcgatgaatatgtgcgaaagctctatccgcatttggtgtcctaattatagcacaattcatttgcaagaacaagttgacattctctgttgaatgtgtattttcttacgtactttacataaagtaatttcggatcttggtaagtgtatcttcaagtacttcatcggaatgcgctgttgaaaggaacattgcttcaaattgagaaggtgccagatggattccctgtttcagcatggctaggaaataatctgcaaatgcttttgtatcagaagacttggctgaagtataatccaccacttcttcttttgcaaaaaacaggcttcccagagaagaaacatgatttacatgatattcacttcctgcctctttcaggatctcttcaattcctccatacagtttctggcctttttcttccagatccttatatacttcctgatgttcatacagatatttcagctgtgtaagtcctgctgccattgcaatcggatttccacttaaagtaccagcctgatataccggacctgcaggagaaaccatttccatgatttctcttcttccgccatatgctcccaccggcatacccgcacctatgatcttgccgtaagtcaccatatccggtgttacgccataatattcagcggcaccgccaaatgccagacgaaatcctgtaataacctcatcaaagatcaacagtgttccatgctgatcgcacaaagtacgaaggccttccagaaaaccttttttcggagcaaccacacccatgttggcagctaccggttcaacgatcaccgctgcaacctgtccttttgcctgctccaaaagagcttttacactgtcaagatcattatagaccgcggtcatcgtatcctgggtacatccctttggtacaccggcgctgtctggaaccccactcgtcatcacaccagaaccggcacttaccagcagcgcatcactgtgtccatggtaacatccggcaaatttaatgattttgtcccttcctgtatagcctctggctgcacggatcgcactcataactgcttctgtaccggaatttaccatacgtaccatttccacatgtggaagatgctcacagataaattctgccatttccacttcaatctctgtagcacatccaaagctcaagccttccgcacatgcttttaccactgcctcccggatttctggaaaattatgtccaaggatcattggtccccaggagtcaatataatcaacataacagttatcatctacatcataaatatggcatccatccgcacgtttgataaatctcggtgccattccaattgcaccataagctcttaccggactgttaacccctcccggaattcttttgaccgcccgttcaaataattcttctgatcttcccattatccaattctcccttcatcaataaaacgcgcaagttcttttgcataataggtaagatatatattcacacctgctctgtatgcacttgctgccatttcgcagacgattttttcttcatcgatccagcccattttagcggcagccttgaccatggcatattcaccgctgacactgtacgctgcaatcggtacattggttgcttttgatacttctgaaaccatatcaagataagacattgccggcttgatcataataatatctgcaccttcttcaatatctgtcagtgcctctttcattccttcacgacgattatggtaatccatctggtaacttttacggtctccaaaagatggtgcagaacctgccgcatcacgaaacgggccataaaaagccgatgcatatttgactgcataagacatgattggtgtttctttatgtcctgctttatccaagcactcacggattgcacgcacacggccatccatcatatcggaaggcgccaccatatcagcacctgcctctacatgagagagtgctgtctttgcaagcagatctaacgtcgcatcattttcaacctcatgtccgcagagcacaccacaatggccatgagaagtatattcacacatacatacatctgtaatatagtaaagatccgggaactgtcttctggcctctctcagtgctttctgaacaattccgtattcatcatatgcgccactgcccacttcatctttatgatctggaataccgaaaagcatgatgctgctgactcctgctttctgcagacgttccagttcatatggaagacgatccacactgtaacggtactgtccctccatagacggaatttcctcttcaattccagtaccttcttttacaaaaagcggatagatcagcgatgatttatcaattcttgtttctcttaccattttacgtaatgtttcacttccacgaagtcttcttggtctctgaatcagatccattttaatgcacctcttccttatttgtttaccttatctgttttttattttaacaaccagttctacaagcgaatcaatggttgctttttctgacatatatgtctgcattccataatcgtctgccgcagcttttgtctgttttccaatgcatgccgcagtaactttggagtaatccaaaagcccggtactctctacaaatccttttacagtagatgcgcttgtaaatactacacaatctatggaatcactttcaatttccctgtcaatatgaatcagactgcttttctcatatactgtatcataggttggaatatcactgacctgtccgccttgttccttaagaatctttacaagcttctgattgccttttctcgccctcggcagaagaatcttctctcctccctgaagtttcactgccagtgcttcgccaagtgattcgccatcataaacttccggaatcagatcaacaagaatgcccctgtcttccagaacttttgccgtgccctgaccgattgcagcaatctgtgctcctgccaggctgcgaatatctttatgtgcttttttcagctcatcaaaaaagatttccactccggtcggactggtaaatacgatccactggtaagaggaaatttcctcaaatgcatgaacaagtgtactctgatcttcaagcggaactgttcgaattgatggaagttccagaacttccgcgccccttctgcgcaattcctccgcggttcgtgaactacgcccctttggacgggttacaagaactttccatcctgcaagaggaagtttttcataccagccaaattcatctgcaagtctgcatacctttccgacaacaatgatcgccggtgtttctattccctgacggtctacttcctccttcagagttgctacggttgccaccaccctcttttgatctgccgtagttcccttttggagaacggccgccggcatagccggatccattccagcttcaagtaaaccaaaacaaatatctgacagtgccgcaatacccatcagaaataccagagttccctttgtattgaccagagctttaaaatctatatcgtattcctttccggcacgtctgtgtccggtaataatatgcacagaagagcaaaaatccctgtgcgttaccggaattccattatatgcaggaactgcaatggatgaagtcacacctggaacgatttcatagggaataccatttacagtcagaagttccagttcttctccgccccttccaaaaagaaacgggtctcctcctttcaagcgaaccacgcgctgacctttctgcgcttcttcaagcaatacctgattgatctgttcctgtggcatcgtatgcttatcagcacgttttcctacatcgatcagacgagccgtggtcggcacttttgcaaggaccccctgccccaccaggctgtcatataccacgacctccgcctgctgaagcacttccatacctttcagtgtgaaaagcccgatatcacccggtccggctcccacaagccacacttttccttttttcatactggctctcctcctgtatatttgtcgttctcctgttcttcatgctcacgcttcatttgttcggccagacacatacccaggcgggccgcttctgtctttggtcctcggatactgtctttaaaatatctgccatctttttccctgtaataaagtcctcgaagaaacagctcctcaccttccacaataccaaatgcagcaaccggtgaggaacagcctccgtccagatatctgacaaaagctctttctgcagtgcctgctatccatgcatcctcgtccttatatccactcagatattcatatttcaggcctttatgtccctgtacggcaagaatcccctgtccggctgccggaagaatctcatctgctgaaaaataacgatgaattcttttttccaggcccagacgcttcaggcctgctgccgcaaggatcagccccgcatattctcctgcatccagcttacgcagtcttgtctgaagatttcccctgatacttttcactttcatatccggataaattgtttgcagctgcaaagtgcgacgaagactggaacagcccagaggtttcaaaggatccaggctggctgcaccctccggcagcaccagaacatctctcggatcctctcttctggaaaaagcaagcagtggcaggtcttccggaacttccatcggcatgtctttcagactgtgcacagacagcattgttctgccttccagcaatgccttgtccagttcttttacaaaaaggccttttccgccaactttgtcaagtgtccggtcaaggattttgtctccagttgttttcattgtaagaatttcaacatccagtcccggatgctgttcttttatgtaatcacgtaccatctcactctgtaaaacagcaagacggctctctctgcttccgataataactttattcttcgctgttgtctgtatcatctgatgcctccattgcttcctgaattgccaagcggacttttttggctctgctgtgatccaggccactggcggtaattccgatcacaacttcatctttcatataaatacccgggaaatagaaatcgcatttactcttatcgtctgcaacattgacataaattccctcttctttacagacgcggtatatctcatcgtttaatttccagtcgtttgtagctgcgatcaccatatatgccatatcaaaatctgacctttttaccggacgtgtaatcagattgacataaccggttttgccaagttcctgcagctccatagtcgatttcggtgcaattgccgtaatatttcttgtaaactgcagcaatgtccttattctcctggtcgcaatatttccgccaccaactacaacgatctttttatcggacagatcaataaacatcggaaaatatcgtttattcttcatatactttctccaatcctgccacacattccagaaaagcttcctgattcaggctgtctctgagcccaaagatcattttattgacaacttttcctgctgcggtatccactgcctcgagaagctgcactctgtcttcttcctgcataggtgtctttttgagtatcttttcaatacggagattcagatcctgaacagcctctgccttaatctcctgaattctcggaattacatctcttccatccagccactgaaaaaattcagccatctgttcttctacgattgcagctgccctgaccagactctcattggcttccggtgacagtttttctgtatggaagctgtccatatcataaagcgtaatattttcttttctgcccagagatggttcaatgtctctcggaaccgcaagatccaaaagcaaaagtggcttccggatcgtaatgtcccggaacaattcttcccgcaaagtaaaattcggactggcggtcgcactgactacaatatcgcagtttggcaaaaagttcatacgttctccataatgaatgcggctgcatcctatcggaatacttaccataccgctgcggtactgacggacagttaccgttacatttgcccctgcatcccgcaaagtctgtgctgcaacttttcccatttcaccatttccgatcaccatgcagatttttccatgcatatcatatccctgctctttcaggtgactgaccgcctgatggataaccgatggatttccatgtgcaagtggtgcttctgtcttgattttctttccggctgtaacagccatgcgaaaaaggacttccagtgtactatctgtcgtaaaatgttcccttgcaaggtttagtgcatctttaatctgcgtcaggatctgatcttcacccagaatctgagatttcagtcctcctgccagataaaaaagatgttctgcagcctcacggtctgttcttgaaacaaaataagattcataagaatcatcctgtatatttttaagctggcaaaggcactggtaaagagaaagttcctggtcgtcttcgtggcttgcccaaatttcaagacgattgcaggttgaaagtatgatacagccatggattcctgctgtctctttgagtttttccattgcttcaccggcatttttctttgtaaacgcaaacaaagcccggatatctacgggcgctctgtcatgatcgatgcctatcatggatattgtcatgatatgtaattctcctttgttgatgtatgataccctttcctgaacgaaatccacccctgtctgaggtggattttcaggaaaaaatactgtttttatgatagacttttcatgctggattgtcaatggaattgaatggatttactcgacatttttagttgcgatgatggcgacacctgtatgcgcaacatctttaaggatcacatctccgatatgcacaggtgcagaaacagtaacatttttaagtgcatgaatacagtcaaaaattttatcttttggaatatcgctctgtgttttgacagataccatattttcaacaccaccagatacgtgaacagttgttgttacaatacgagtcggatctgttacctccttctttccatatattgcacctcttttacaggtatttccttctacacttaatacggttccattttctattttcactgtaagcgggcagcccattggacagccaatgcatgtcagatttctcgtctccatactctatgcctcctcaattttaagtgtgattttatctgcatatggatatcccagcagctgttcttttgtcagtttgatctgttccatctcaccaggtgccactaccggacgttttctgtggataattctctctttacctaaataacagctgatataacagtttttatatactccgccgacgcggaaacgaactgtcagctcttttgccatatgttctatgcgaatcacggaaggaaccgtatatcttactcctgcttctggcaccaaaagtatttctcgtgcatctttataggattcacctgcattctcttttctccgaacatacatggatgcattccgtccggcagctgcagcctcttccgatacaaaatccaccagatcatgaacatgaagcacatttccacatgcaaaaacaccttccatgtttgtttccaggctttcatttacccttgggcctgaagtgaccggattcagttcaactcccattccacgtgaaatttcattttccggaatcaaaccaaccgaaagaagcagcgtatcacattcatattcttcctctgttccaggaattggcttacctgacttgtctacttctgcaagagtaataccctccactctttcttttccttttatatcgattacagtatggctaagtttcagcggaattccaaaatcatccagacactgtacaatatttcgcttcaatccgccggaatatggcatcagttctgcaacaacttgtacttctgcaccttccagagtcattcttcttgccatgatcagaccaatatcacctgatccaagaatcacaactttgcgtcctggaagatatccctcaatgttaacaagacgctgtgcagttcctgccgaaaaaatgcctgccggacggtatcccggaatattaagtgctccccgggaacgttctctgcatcccattgcaagaatcactgcttttgcctggatctgaaacattccatcttcacggttcatcgctgttataaccttgtcagcactgatatccatgaccatagtgtgtaatttatactttattcccaattcaataacctgtgtgataaaacgtccggcatattccggtcctgtcagttcttcctgaaatgtatgaagaccaaatccattgtgaatacactgattcagaattcctccgagttccttgtctctttcaagaatcaaaatgctttctgttccattctttcgtgctgcaacagctgccgacaatcctgccgggccaccaccaatgattacaatatcatatgttttcatttgtttccctcctgaaatgaatctttatttacgccttcaatgattctggaatctccgccacattttgtgatttttccaattggagtttcaagttctctcgcaagaatttccattgttctcggtgaacagaagcctgcctgacatcgtcccatgcctgctctggtacgtcgtttgataccatcaagggatctggctccaacaggtcttttgatcgcatcaataatttccccttcgcttaccatttcacatcggcaaataatatttccataagccggattgcgacgaatatattcgtttctctcttcaagcgacattgcattcaggtcagcaataccttttcttgttgatacaaagttttctttttctttcaggtcatattttttcttaagaatatctgcaaccatttctccgattgccggtgcactggataatcccggggattcaattccggcacagtctataaaatctttttccgtttctccaataataaaatcatctccgtcttcatgggctcgaagacctgcaaaagatgtgatcacctgtcttgtcggaatatttctgacgctgttggaggatttgataagtacctgatccagcccatctctcgttgtatttgttccttctttattttcaatatcctgtgcagttggaccaatcagcagatttccatgaacagtaggcgtaaccagaacacctttgccaaattttcccgggagtgcaaaaactgtatgactcacatggctgcccgcacttttgtcaaggagacagtattcacctttacgtggtataatatgaattttcttttcgctgaccatattatgaaaacgatcagcatagactccagctgcattaataatacattttgtttcataagtaccactagttgtttcaattttccagttctctgtaccagaagaaatccgtgaaatgtttaatacttctgtatcaaaacgaaactccactccattgacacaggcattttccgcaaaagcaatcgtcatattaaacggacacacaattccaccggttggcgcgtacagagctgcgtacacattttcagacacatttggttccatctccagcacttcatcatgattcaaaatccgaagcttctttaccccatttgtaattcctttttcataaagcttctgtagatttggatagtctttttcgtccagacatagcacaagtgaaccattccgtttaaatggaaaatccagtttttcagccagttctccaatcagcagatttcctcttacatttaattttgctttcaaagttcccggttctgcatcgtaaccggcatggatgatcgcactgtttgctttggaagttccacaacatacatcttcctctctttccagtacacaggtttttatctgataatgggacagttctcttgcaactgccgtaccggtaactccagcaccaataatgatcacatcatatttttccatttttattttcctcctcattgttgaattctatataaaaaaaagcccgacaaataaacccatgtatcatggatctaatgtcaggctctcttctctcatgccatcatatatttttatttttgtaatcagttttcttcatcacgtgcccatccgtaggcatatttgactgctttctcccatccacgaatgcgtttacttcgcgcttcatctgtgatctctgggataaaggtcttatcaattgcccaattctgaaggacttcttccttgctggtccagtatttgacagcaagccctgccagataagcagcacccatggccgttgtctctacgcatcgtggacgattgaccggagcgttaatgatatctgcctgcgtctgcatcaaaaagtcattcgcactggctcctccatctaccttaagtgaagccagttgaataccggaatctgctctcatggactgcagcacatcatttacctgatatgcaagagagtccagcgtcgcacggatgatgtgatatttatttaccccacgggtaattccaacgatcgtccccctcgcatactgatcccagtgtggagctcccaacccggtaaaagctggcacaacataacaaccatttgtatctttgactttctttgccatatattccgaatcctcagcagaatcaatcagacgcatttcatctcgaagccactggattgcagctcctgcaacaaaaatcgaaccttccaacgcataattcactttgccatccaggccccaggcaattgtcgtaaccaggccattttcggaaaaaacaggtttctcacccgtattcatcagaagaaagcagccggtaccatatgtattttttgcttcgcctggctggaaacaagtctgtccgaacaatgcagactgctggtctcctgcagctcctgcaatcggaattggtcctcccaggaaagaaggatctgccgtaccataaatacaactggacggttttggtgtcggaagcatagatttggggatattcaattcttcaagtatttcatcatcccactgcagcgtattgatattaaacaacattgttcgggatgcgttggaataatctgtaacatgtactgcacccttggtcagtttccagatcagccaggtttcgactgttccgaaaagaaggtctccacgttctgctttttctctggctcccggcacattatccagaatccattttaccttagttgctgaaaaatacgcatcgatcaccagtccggtcttcatacggaatttatcggtgagtccctttgctttcagagaatcacaatactcagatgtcctgcggcactgccatacgattgcatgatagattggatcaccggtgtttttatcccagacaattgcggtttcacgctgattcgtaataccaattgccgcaatatcgcgtgcctctgctccaatcatattcatcgcttcaactgctacaccaagcatgcttgcccagatttcatccgcatcatgctctacccagcctggcttcggaaaatactggtgaaattcacgctgtgccacgctgcacatttctcctttttcgttaaataagatacaacgattgctggttgtccccgcatccagcgccataatatatttgttcatataaaaacctcccttttaaaagtgtatttgaattacaaattccacactttatgattggttgaagagacggctgtcgctccagcagtgagggctcccatcacggattctttgtcagtgatcagacctccggcgatcacaggcactttgatttcagcacacagtctatgtataacttttggcattgcacctggaagaacttcaatgaaatcaggatgtacactgtgctgctgcgaaagaatattctcgtatgccatcgaatccaaaaggaaataacgaagtaccgtatacatagaaagttctctggcctttcggaccaatgccggctttgtcgtaatgattccatcagcttctgtattattctttaaaaattcaacagcaatttctctcgtacttaatcctccgatcaggtcaacatggatcatcgcaatcttacccgcttctttaaccttttgtacaatgtcggcaatagaacagatatctccaaataaaataaacaccacatgtatatctgaaaggctgcaacacttctccagatcttccatatttttcactgctgctatgattgggttttcttctactgcctcccagaatatacgttccatcttaagttccttccccactgttctttgcaaaaaaaatgagcacaagtaaaacagcgatccactgtttccaatatgctctcctgtctcggcatgaattattttttatctgaaataaatataccacagataatcaaaaaacacaataaaaaagaggttaaatcttttttattgtgtttttacaaaattatcattctgtttattataccgttatgtattattataatttttaatacacaaacctattaaggaagtacccttaaattacccaaaagttgtccgtacaaacaaccttcctgtatgtttcaaatctaaaccatttattgtgtacctcagagcgtttctctaccgtaacctcttttgcttccgcaaggaatttttcaagatccgctctgctcttcacaagcaatgccattcctctctcatctacaaccggaagtcccacataacgatagtcttcaatcttctgaatatcttccaccttgccatcgcggatcaaaactgctgcgccatcctctacagaaagaatatcaaaatattctggatatttgaagctgtccccaacagccggcacttcgtcaccgacatgataagtcttcttatcagaaccagctttggacatcatcgcattttcaagattaaaataaaattcttcaaatacataaccaccgactttgatgtcatctttctggaaatatggtttctctccgtcattttctactgtttcaagcacaccacaggcagatgtcatatggcttacgcggtcgatcagaatcatctcgccaagtgtcttgtgtttcttaaactcgtcaagaacgatcttctcagccagttcgatctcacacagagcaatctcatttttctcaatatgatctgctgagatatgttcacctgtattgacatcgattttatatttaatgctacggatgaatccaggaattctcttggttcccagtttgaccagatactcttttccaagtgtcagcttactgtcatccatccagagaagtgttgcagtaaagctttttgctacggagagccgggcctggtcagtgagtacgcagcctcggctgacatctacttctttatcaagctggatcgttactgcctgtcctgtcactgcttcctctacggaagtacttccgttcagaagagattttaccgttgcagtctcattgcttggaagtgtggtgatagtctgtccgactttgatcttaccactttcaatctgtccctgaaaaccacggaattcgtggttaggacggcagactctctgaaccggcatgtagaatcctgcttcgctctctgtctctgtcacatcgactgtttccagatgatccaaaagtgttttgcctgtataccaaggcatgttctcagattttacagttacattgtctccttctgttgcactgaccggaatgatcacaacatcctgaagtccaagattttctgaaagttcattgatgtcttttacaatctcattgaatctttcttcgctgtagcctacaaggtccatcttgttgactgcaaatacaaagtgatggattcccatcagggcacagatacggctgtggcgtcttgtctgtaccagaacaccctgttttgcatcgacaaggatgattgcaagctgtgcaaaagaagcaccaactgccatgtttcttgtatattcttcatgtcccggtgtatctgcaacgatgaagcttctcttatctgttgtaaaatagcgataggcaacatcaatagtgatgccctgttctctctctgccatcagaccatccagaagaagtgaatagtcgatcgcaccgcctctggatcctaccttactgtcaaggatcagggctttttcctggtctgcataaagcagcttagaatcgtaaagtatatgtccgatcagtgtagattttccatcatccacactaccgcaggtaataaatttcagtaaaccactcatctagaagtacccctctctctttctcttttccatgctggctgcaccgccgtcagaatcaatgattcggctggttctctcagattcaacagaacttaatgtctcatcgatgatcgcatcaagggtatctgcatcagaaaggataccgccagtcagtggataacagcccagggtacggaaacggacttttttcatttccggtttctcgccagatttcagacgcatacggtcatcatctaccataatgatgttgccgtcacgataaactaccggacgctcttttgcaaagtaaagcggcacgatcggaatgttttctctttttatgtactgccagatatctttctctgtccagttggagattgggaaaacacggatactctcgcctttgttgatctctgtattgtaaagtttccacatctccggtctctggttcttcggatcccaggcgtggttttcattacgaaaagaaaagatcctctctttggcacggctcttttcctcatcacgacggccgcctccgaatgctgcggtaaatccgtatttgttgagggcctgcttcagagcctgtgttttcatgatatcagtataagcggatccgttgtcaaatgggttgattccctgcttcacaccgtcctcattgatatattccagcatttcgattccaagatcttttgctgtcttgtcacgaaactcgatcatttccttgaatttccaggttgtatttacatgtaaaaacgggaaaggtggtttttccggataaaaggctttcagtgcgagatgaagcatcactgagctgtcttttccaatggaataaagcataacaggtttttcgcattctgctgccacttcccggataatatatattgcttctgcttccagttcatctaaatgtgataatccgctcatagttctactcctgtactaatatttattggaatttcgccggtcaacgctgatgaccagttcactgccgtcagatctggtgatgttccagttgaggagatcacctttctgggtaacattcatggttccacccataccaccgatatctgcgccaagataaaattcaatggctcctgccttacattcttttacgcaggaaacgcagccccagcagtttttcgggtatttcatgactgcttttctgtctatgatctgaatcagggtaccaggacatacttcctgacatttaccgcagccgacacatcgctcttcacgaattcgtatgctcataagtatccccctttaccagatcccggaacagaatacggatctttccgtcttccattctggaatttacatatttttcaaacttctggtctgtttccggataatctagattctcattgaaagaatgccatctggtttcttttctattcttaagatgctcgatcagcacctgacagacaagaagtctttctttcaattcgtatgcaaaaagaagttcatgcatatcttctgcaccgacctgatctgccagttcacttaatcttgtaattttttcttctgcaagatttaactgtttctcattgaactgatagttgctggcgattccacctgcatattcgtccatgactttctgcatggcttcttccagttcgtcgatggtaaacagaccgttttctccattgcggatcttttcgtagtcagcaaggatcatctgtgcctgtttttcgatttcggatgtttcttcactgtgatcgtcttttaactgttcgatgattgcgagagaggcgatcttgccctctgccagagcaccggttacatatttctgaggacatccgcctgccacatcaccggctgcataaagtccgtggatggtagtctctcttctggtatctacccagaatccactggctgtatgaccacctacgatgtacggttctgttccttggatctctacgtcctgttcgctcggcatcttgccgctctcgatccatttgagagtctggctcggtgccatgttcaggtatgctttgagaagatcctgatcctgttcggatgtgataccggaagtcttaaggtaacacgggccatgaccaagctggttttctttgacggttccatacacacgctgactggtagtcagaccataaatatgctcgtagacttcgcctttggagttgacctgctttgcctgcacgccctgtgcgatggttcctgtcggagcaatcgtatctttacagcgaagtgcgataaaacgcatctcaaaggttgtcatttctgcaccggaacggattcccattgtgtatccggctcctgtattaaatggaggataccacatcttatgcctggaaaatcccggattgtttggtttgtagagaccggcagctccgcctgttgcgattagaacggctttcgcatggatcacataggcagtttcttccatgatggaaaaaccgacagctccgtagactcttccattttccgtaagaaggtctgtgatgtttacgtagttgagaacatctacgttttcacttttatatacggcatccgcaagaagtggtttaaagttttcgccattgatcttaatgttacggtttcctcttgccacatagtctccgttttcatctttaaggatcacgagaccaagtttttccatatctgccgttacttcgttaaattcttctgcggctgtcagaaggaggtcgtttctgacgattcctgccgcatctttagttgcgtaatctacgtaatcctgtggtcggcggccttttacaatataggcgttgatcgcgttgacacctgctgcaagacagccgcttcgtttgatatttgccttttctgcaacaagaatgttaagtccagagtttctgctgattgtgagtgcggcataacagcctgcagttccgccgcctatgatcaggacatctgtatgtaagtgttttacctgtaagggtttgctcatggttttttcttccttactttattctgtgatctcgatctcgtgaatcgtgacatttttttctttgtcgattccgaatgctttgagtaccggatttccttcttccataagggagaggataaggtattcaatggtcgggtcaaatgccaggcgtttgtcttcttcggatggacgggatggggattccggatgggaatggaagtttccgatgatcttgtatccgtttgctctggcatctttgagggctgcaagctgctctttgggatccatggaaaaatgttctctgctggcatccacatttgtgaggagatagaccttcgtgacggtgatctcttcgtcttcttctgttcctgcaaggaggccgcaggattcatttgggaggccggcggtgcaatgcgtcaggatggtattatagtgtgatttttttaaatataatttcataataaaagttcctctaataactacgtgtacatgataaacaattcaccgaagatacgctctcgctgccttcgattggtagcggtacataagtgaccacaatacggtcactaagtaccgaccatctcagagcatcttcttatgaatttgtttatctgtacacttgaatttagctccacacggtcagcttcgccagtttcagctaatggctaccaaaattctgtgccgaaggcattgtaatatatcttttagtgcaatttgtcttagtgtaattgttatctctgcgtattcacagtgtgcggataaatatttcgagagaagatgctctgaggcggccggtacttagggattgttttttaatcccttagtatccgctgccagtcgaaggcagcgagagcgtatcttcgatgaaatatttgatctcgcacacgtaaggctatagtctataatctataatccatattacatatgcatgtcgcattctgcctgctcgtaatcgatcaatttggtgatcgtcgggtggtctccgcataccgggcagtcatggttctttggaagtttaatggtacggaaagtcatagacagtgcatcataggtaagaagtcttcctgtgagaagttctcctttgccgataatgtatttgattgcttccattgcctgaaggcttccgatgactccacccatagctccgataacgccggcctgtttacaagtcggtactgcgtccttcggcggcggatctttaaatatacatctataacatggtccttctcctggaacataggtcataagctggcctttgaaacggatgattcctgcatgagagaatggtttctgtgccatgacacaggcatcattgatcaggaattttgccggaaagttatcggttccgtcaataataaagtcgtagtctttgatgatatccatgatattctcggatgtgatgaacttgcggtatgtatttactttgacatccggattgattgcctgcatggtttcttttgccgactttacttttgcttttccaagatctgctgttgtatggataacctgtctctgaagattggaaagatcaacttcatccgcatcggcaattccgatcgttcctacacctgctgccgccagatacatagctgccggtgctccaagtccacctgccccaataatcagtacactggcgttcaggagttttttctgtcctttggcaccaacctctttgaggatgatatgacgggaataacgctctaactgttcattcgtaaatgccattatcttgctcctcctcccatgaagtacaggaattcgatttcatcaccgtctttcacttctgtggattcaaaagctccactttctacgaattcatcattgatagttactgtaacatactgtggtgtttctatatcctctttctcaatcagttctttaactgtaagtccttccggatattctttcttttctcctgctactttgataaacataatgattattctccttttatatatttgatcacgcacacataaacttattaaataaacttatcaaagatattcttcaaacagtgcttctacttcttcctgttctttcagtccgactactttccccttctgctctccgttcacaaaacagatcaccgtcggaacagacataaccttatattgctcagcaagtgccttatcataatttacgttcactttgtaaatataaacagtatcctcatgttcatcttcgatatccccaagtattcctgccatctgtttgcatggaatacaagtatcagagtaaaaatcaatgaggaccggcttatctgcttttaacactttttcttcgaaattctctgcattgattctgagtgccatatcattcatcctctactttcttaacgatcagggtaaatgtatcatccccattgtcttccagtttcagaatctgatgtccttcttctttaatacttctcggaacattctgtaccggttctccattattcatacgaacagcaagaatctgtccgtcatcaagttcctccagcgcaacctttgcttttacaaatgttaccggacatacaacatccgtaatatctacggtatcatcaattttataatcagccatcataagctcctttcagtacttcgtacagtttttcttctccaactcgatcaattgtaaatttgaatcgctctcctgcatttgcatgatctgcaaaaaactggatggctgcatctgtcacacggaacagctgctcttcagaagtgatcagtggaaggaattctcttcccttactgatatgatttccaaaagtaccaccaaatgatacaagaaatgcctcatttacatcccatgcatctaccggacaggattttgcacatctgccacaatagttgcatttttcattatcgatgatcagtttatcatcctggaaagaaattgcttcttcacgacatgccttttcgcagacaccacaatgaatacaggtatcttctttccagctgatctgtgctgctcccttgattccaacatcattttcttctgctttgaggcagttgttctgacatcccgtcacaccaaatttaaacttgtgaggaagttctcgtccaaaatatctttcgtttaattttactgcgatgtcatagctgttgatatttccacttggacagactgcattgccctgacaggctgttactgtgcggactctcggtccacagacacccggacgacatccacctttggcaagatctgctgttacatcatcaatatcgtctaatttaataaaaggaatctcaactccctgtctggaagtcagatgaacatatccatctccgtatttttctgcaacttccgcaatctttttgaggttctctgccgtaagagctccaccaacgcaggcaagtctgagtgaaaaattatttttctgtttctggcgcataaatccgcctttttttaaggttgcgtaatcaacttttgccattttcgtcatctccttctattactcttttgaaatcttctttcaaatcttctatatcttcaattccgacactgattcgaatcatatcatcataaactcctgagagttctttttcctcctgtgacaaatgagctgctatcgtactcgatggatgaatcactagtgtcttggtatctccaatattggaaaccagccatggaattttcaattcatttaatatctgaaaagctctttctttgctttctgttcttaatgtaatgattgctccaaatccaccatggaactgttttgccgcaatctcatgatatggatgttccttaagtcccggataggaaaccgtaatgccgtgtcctaatccattcagaaactccgccagctccatggcgttactacagtggcgctgcattcgaagaccaagtgtctcaagtcccagattattgagaaaagcattctgtggtgccagacaggctcccatgcttcgaaacaatccgtttcgcaatttagcaagataagcaaaaggtccaaactttttgaattctttcattcctggatatttatctgcatcccatttaaactttccgccgcttatcagtataccactgattgcatcactgcttccattgatatatttagaagaggaatgaataactacatctgctccaagtttcaatggattgatcagataaggtgtcgctactgtattatccacaagaaatggaattccatatttatgtgcaatttctgcaactccctgaatatccgtgacatccagtttcggatttccgattgtctcagcaaaaacagctctggtctcaggggtgatttccgcctcaaaagcctgcggtgtattgacttttacataagttgtcgtaacaccatatactttcagctcatccagaagttccacagttcctccatataagccagctgctgcaacaacatggtctcctctctgaaggacattcataagagccatgctaagtgccgccatgccggaagaacacgccacacttccaatcccgccttcaagctttgccatccttttttcaaaagattctatcgtcgggttgttgattcttgtgtaagaatacccagccattttatttgaaaagattttctcaagttcctcagctgtatcatgacggaatgcactggactggtagatcggtacctgtgtcgcaccgtgaggattgttaccctctgtcccatgaagcaaagttgtattaaaaccgtattctttcattcctgtgctccttttttcttttcatttgtgttggtattactatatacctataaacataccatgtcaataggtaatgtatgcttttttccattttttctataaatttacaattttaaactttattacgcagaaaaaaagaacagccactgtacttctgacagttctgttctcttgatccgacagctattttacttattctgatctgccctttgttccgcgctattcatcagattacatagtctcctgtatctgtgctctgctccagaaggtcttccaaagtaattccgtcaaaatattcattgagcagcttatagaaaccttcccacatctgcagtgttttgcaggatgacgctctctcgcactgattcggatgatcatccagacaggcaaccggtgccattgaaccttccgtgatacgcaggatacttccgatcgtatattcagcaggagtcctgaccaggcgataccctccaccttttcctcgaagcgctttgacaaatttctgtttgctcaagacagaaacaatggactcgagatatttctcagaaatctcctgtcttttcgcaatgtccattaatggaatatactctccattattatgttctgcaagatccagcataacgcggatcgcataacgtcctctcgttgatatcttcatgaaatcccctccataaacctattataccacaaggttatagggaaaacaagtgtcaatcatcagattacaagataatcttctcttgcagagctgttctccagtgcatatactttgttttcttttattacaaaaagccgctgtacaaacacatccactttttctccctgacggaccaggggttcatccagtcctcttcttgcagacagcacaacttctccaagtttcagctgaagttcaaaataactgcctctgaaagccacacgttcaacatctgcttccgatgcagaacttttgtatttctgtacttcattttttctggtcacctttacaaactcaggacgtacaattgcatattctgcacccggaatatcttcaaagtaattgaagacatgataatccctgactgtagccgcctgtccaaaaaaagacgcactaaaagcagtttcaggactctgatatacctctaccgggctgcctttctgttcaatatgtccccggtttgtaataatgatctcatctgccacttcaattgcctcatcctggtcatgcgtaacaaaaatactggtgatcccaagtttttcaatcatatccttcaaccacgtacgaagttcctgtcggatttttgcatcaatcgctgcaaacggctcatccaacagaagaagctgcggatttggtgcaagagctctcgcaaaagccactctctgtctctgaccaccggaaagttgacttggatatcttttttcaagtcctttcagtccgatcagttcaatcaattccgttactctttttttaatataggttttatccgctttctgtactttcagaccaaatgcaatattgtcataaactgtcatgtaacgaaataacgcataactttgaaatacaaatcctattccacgttcgcttgccggtatatcattcactacttttccgtcaataatgatctccccgctgtctggctgttccagtcccgcaatcatacgtagtattgtcgtttttccacttccacttggtccaagcagaccgatcagttttcctttctcaattccgaaggaaacatgatctgaagctttatagcccccaaaggttttattgatatcttttaattccacgtacattatgcttcctcctcttttttgcctttatactccatgatgcttcgaatgaccagaagaataattgccatgattaccagaattgatgatacagcaaatgccgaaacatactggaattcattaaataaaatttctacatgcagcggcaatgtattcgtcagtcccctgagatgacctgacagtacagatactgcgccaaattcccccatggctcttgcagtacagagtacgattccatacaacagcgcccatttgatatgtggaaatgttatttttgaaaaaatcgtccatccttttgctcccataagtgctgctgcttcttcctcatccgttccaatcgactccagtaccggaagcaattcacgaaaaacaaatggaaatgttacaaatacagtcgccagaatgattcccggaacagcaaatacaatctggatatttgctttttgcagatacgggtaaagaatgctctgttttccaaatacaagaagatagatcagacctgcaatgattggcgaaaccgtgactggtacatcgatcagagtcgtcagaaattttttccctttaaactgaaatcgcgtcactgcccaggctgcacataagcccaaaacagtgttacataataccgcagtgactgttgcttttaacgtcagcatcagtgcagcgatcgtaaaagaatctgtcaccgcttccacataaacctgccatccttttttcaatgcctccgttacaactacaatcaaaggaagcaccagcataacaaaaagaaagagaatgctgattccgatcagcagatatttgaccagctttgattcttttttcttacccatcacgcattgcctcctctcagtctttttgaattgcgtgcctgcatcagattcatcagaaacagaatcaggaatgaagccaccagcataaccagtgcaatggatgtggcacttttataatcaaattcctgtaattcagacataatgatcaatggtgtgatctctgtttcatacggtctgtttcctgcaataaatactacgcttccatattctcccaggcatcgtccaaatgcaagtccggttccagtcaaaagcggcggtaaaagttccggaagaatcactcttcgaaaaatataggctggctttgcgcccataactcttgccgcttcttcataagaaccatccagtttctcaagaaccggctgaacagctctcgctacaaaaggaatccccacaaagatcagtgcaaatgtaattccaagctttgtataggcaatcttaattccaaactttgcaaaaaagcttccgatcagtccctgatccgaagtaagggaagtcagagaaatgcctgctactgctgttggaagcgcaaatggaagttcaatcattccatccatgatcctttttcccggaaattcataacgtaccagcacccatgccaggatcagccccatcactgcatttacaaaagaagctccaagagccgtaataaaactcacataaaaactggataaaattcttttacgggttataacctcaataaattcattaaacccaagttgggaagaatagattacaagtgacgccagcggaatcagaacaacaatgctcagcatagtgattgtcacacccatcgtcagtccaaatcccggtatcactctttttttgctttttttcataatatccactcctcatcttctagtttccatagattctgtcaaaaactcctccatctgcaaaatgtttccgctgcacttcctgccagccgccaaaatcatcaatcgtcttcagttccatattcagatcaaaaacatcactgtattcctccaaaatttcctgattgaccggacgataataattctcagctgcaattctctgtgcgtcatcagaatacagataattcagatattccctggaaacttcttctgtaccacgattctctgcgacctcatccacaacagctaccgacggttgagccagaacactgatactcggagcaatgatctcaaattcatccggatcatcttttacagaaagaaatgcttcattttcccaggcaatcagcacatctccctgcccgttttctacaaaagaggtcgtagcacttcttgctccggaatccagtaccagaacattctggtataatttctttataaatgcttccatcttctcttcatcattattatatattttctgagcataagcccaggctgccagataattccatcgtgcaccgccggatgtcttcgggtttggagtgatcacatcgacatcatctcggatgaggtcatcccagtcctggatattctttggatttcctttccgtaccagaaatacgatcgtagatgtgtacggagcactgtcatcaggaagttcttccttccatccactctgaatcatgccggcattttcgattgcatcaatatcataatcaagtgcaagtgtcactacatctgcctgcaggccgttgatcacttccagtgcctgtttgccggagcctccatgtgactggatcacatcaacatcctgtcctgttttttctttccagtgttccttaaaaatctcattataggactcgtaaagttctcttgtcggatcataagaaacattgatgatatgtatgtttgaacctgcaccggcatcgtaagaacagacgccggcaaatgcagctattccaagtactgataccaggcagatgtttctgaatttcttttttatcatttattccactcccgttggatgatcatttcgttaacatatgtgattggtatgttttacgttaatggcattatataccaataaacatagtttttaaatatgtttataagaaaacgtttgcacaggcatataaaaaagcagctgccatcatttatgataacagctgcaatcctgccggaagctatttcacatcatcgtaagtatcaaggaaattatgtctcacaccatcctgtttatacccaatgactgtattcagatttacattctcaacacttcggaaaatattatactcaattaccggatctttctgagcgagttcgtgaatcaattccttgatctctgcacgcttggaacctttttccgtaccaccacaggaagcacaatgctccgtaaaacgacacgcacactgaataaaatgaagatcattgtagttcgcccagtgaatgatatccgcctcacggatcagatacagcgggcgaatcagttccattccctcaaagtttgtactgtgaagcttcggcatcatcgtctgtacctgcgcaccgtaaagcattcccatcaggatcgtttcaataacatcgtcataatgatgccctaacgcaatcttattgcaaccaagttcctttgctttgctgtatagataacctcttctcatacgagcacagagataacacggtgactgttcctcagatgctacaatattaaagatatccgactcaaatactgtgatcggaacattcaggatctgtgcattatctttgatcgtctgatagttgatctcattgtatcccggattcattacaagaaagacaacttcaaaattcttttttccatgacgggaaagctcctgaaacaactttgccatcaacatggaatcttttccaccagaaatgcagactgcaattttatcaccatcctgcaccagttcatattctctgattgccttcgtaaaccgtctccagataggtttgcggaatttcttgataatgcttcgttcaatgtcctttgtacgctgttccgccgcattgtgatcagccatcattttgctgagcttcatcttaagccatgcacgatagccatttttgatgctgtaaatttcatatccctgttctgtcagctcttctgcgatttcttcactcttctgaccggtataacagagcaggtaaaccggacagtctttacgtatttcatccatatgcgctgccaattcctcccagtaaatattgaccgcaccaggataagtctccttctcaaaatccgcggcatcacggatatctatgatctgcttttctcttgtatcttcctgtaactcttcaattgttctaatacacatatcaatcttccttatacttttcttatatacagtaatcactccagaagctctccgaaacatgagagcagctgtttcttaccagcagtttcccggatagttccattcggactactcccgaatggccgcctttcattctgtccagaagcagatacagggcaaatcgtcccatttcttcttttggaagaccaactgtcgtcagcattggtttggtaaattgcgcttcttcaatatcgtcactggctataatggatggagtaaaatacagatttctgcactttctgagatatttcagtatacccacagccgtgatatcatttgcgcagtaaatgccagtcgggcagtcctcagatttcaaaagcttctccattgcctcatagccttctctctctgtctgatctgtttctactacatactccggtatgacatccaggttatttttcttcaacgtatccagataaccaacataacgatcttcatttctgcagccgcctacatatccgatgtttctatgaccaagcgagatcaaatgttcaactgccatctgtgcaattttctttccatcgcacaaaacctcatcaacttcataatttgtagaatttcgattaacagatacaacacttctgtatttctgattcagtttcttcaaagcaagcggattacagcgtccaatgatgatcagtccatctttattttcttctgtctcagtatacattcgctgaatgatctggtcaagattttctcttctgcattttcgatcatcagaaaaaagcggcatataccagacttttgataaaatacagttatgttcatgtatctcactttctacaaccctgagcaattctgtaaaaaaaggatctgttctggattcatctgtacgtgtcataaggacattgatataccagattttgctttcttttgcctgtgttccctttttcaggttacgtgccgcctcatttggaacataattcatttccatggcaattgaccagactttttctctgaggccaggcactgaacatttgtaatccggccggttcaggatacgtgatacggttgatatagatactcctgctttttctgcgatctttttgattgacatatgtatttcctctctctgccttccttcgacagatctcagtaaaaaaagaaccggaagtcaggacagccctgtgtctctaacccccggtaatattcagatatagtacatttcctgtttatcatagtgatcggaataatatccgctcatttgtgccaaagttaaatttgacagaatctgatcgagttcctggttgacggaatccaccaccagtttctgaatcgtgtcagagattcctttataactgttttccgccagaacatcctcatcttcaaggtggtaactgccttccagtacttccaccacagatgcaaccgtaatctcgtcagcagcttttgccagattatatcctccctgggagcctttgacactttttactatgcctgttctgcggaacgaggcaaatatgtgttccagaaactggagagaaatgtcatttctctcagcaatggttttcagggctaccggtgtggtggacggctgagcagccagatccaccaacgcagtgagaccatatctggtttttttacagaatttcaattactggattgctttgaaagcttcgtccagatcctgaatgatatcatcgatgttttctgttccgatggaaagacggattgtgttcggtttgataccctgatccagaagctcttcttctgtgcactggctgtgtgtggtggttgcaggatggataaccagtgatttaacatctgctacgtttgcaaggagtgaaaacagttccagattatcgatgaagtctttggctgtctgtgcatctcccttgatttcgaatgtgaagatagatccaccaccattcgggaagtattttgcatacagtgccttctggctttcatcatctgttacagacggatgatgaactttttctacctgcggatgattattcagatactgaacaactttcagtgcattctcaacatgacgttctacacggagagacagtgtttcaagtccctgcaggaagatgaatgagcttactggagaaatagttgctcctgtatcacgaagaaggattgcacggatctttgtaacaaatgcagccggtccgcatgcttttgtaaagctgattccatgataactcgggtttggctctgtcagagacgggaacttaccggaagcttcccagtcaaatttaccaccttcaacgatgacaccaccgattgttgttccatgtccaccgatgaattttgttgcagaatgaacaacgatatcagcaccgtattcaatcggtcttacaaggtatggtgttgcaaatgtattatctacaacaagcggaatctgatgtctgtgtgcaatctcagcgcatgcctcaacgtcaacaacgtcagagttcggatttccaagagtctcgatgtaaagtgctttggtgttgtcctggattgcattctctacctcttcaagattgaagatatcaacaaatgttgttgtgattccgtatgccggaagtgtatgctccagaaggtttgttgttccaccgtagatattctttgctgctacgatatgatctccattctgtgcaaggttttcgattgtatatgtaattgctgctgcaccggaagctactgcaagtgcagctgtaccaccttcaagagctgcaattcttttttcaaaaacatcttctgtcgggtttgtcagacgaccatagatgttacctgcatctgccagtccgaaacgagctgctgcatgatcgcagttacggaatacataagaagaagtctggtagattggaacggctcttgcgtcagtaaccggatccggctgttcctgtcctacgtgaagctgaagtgtttcaaatttgaattttctgttttctcttgtgattttttcacccatgaatctgatcctcttttctgtttttttgaatttttgttgctatattatgtaccacggagtgttccgtagcaagctactcccacactcctgcaaatattcgaaatccgctgatttactatcgtaaatcgctactttctcatatttggcgggttccaaactcaaaagccttatcgtgcaagcacgaacgtcttttgcagtttttaaccctggtgttcctttattctgtaaataacgctgttgagtaatatctgtcaccagtatccggaagaagtgctacgatagtctttcctttgttttccggacgttttgcaagttcaattgctgcataaagagctgctcctgaagaaatacccacgagaacgccttctttcttggcaagaagttttgctgttgtgaagcatacttcattgtcgattggcatgatctcgtcataaatctgtgtgttcaggacttccggaacgaatcctgctccgataccctgaatcttatgcgggccgccttttccttcggaaagaaccggggaagttgcaggttctactgctacgatcttaatatccgggttctgctctttcaggtattctcctgttcctgtaagtgttccgcctgtgccgacaccagctacgaagatgtctacctttccgtctgtatccttccaaatctcaggacctgtagtagctttatgtgcagccgggtttgccggatttacaaactgtcccgggatgtagctgtttggaatttcttttgcaagttcatctgcttttgcgatagcacccttcattccttttgcaccttctgtcagaaccagttcagcaccataagctttcaggatgtttctacgttcaatgctcatagtctctggcatggtaagaatgattctgtagcctttggctgccgcgatagaagcaagaccaatacctgtatttccagatgtaggctcaatgattacggctccttctttcagaagtcccctggcttctgcatcttcgatcattgcttttgcaattctgtcttttacacttcctgccggattgaaatattccagtttcacaagtattgttgcttccagtccaagttccttctctacatttgttacttctacaagtggagtgtttccgatcagtccaagtgttcctttataaatgtttgccatggtgtttaccgcctttctttttacttatttattcgtgtctgttttttattaacatacctctttgatatgtttagtatgttattcctttttacccgaaatgtcaataggtttttggaaaaaatttgaactttttttcgcagtattgtataattcatttatacgcgaaaaataaatacttaggagaatactttttatgaatcagcagacagataaagcgattctggtcgtgagcttcggaaccagctatgaagcatcccgaaaagccactatagagaagattgagcaggacattagaaacgcttttcaggatcatcggatctatcgtgcatggaccagtaaatttatcatctcaattctgaaaaaaagagataactatacggttccgactgtaaaggaagctcttaaacaaatgatcacagacgggatccgggaggtggttgttcagccgacccatatcctggacggtatcgagaataatattatgaaagaagaagttctttcttataaagaatcttttgacaaaatcgcatttggaactcctcttcttgcagattcgaaagatgaatcacaggcaatcaacgcagtaacaacagaattttctgatctgaaagaaacagaagctcttgtattcatgggacatggaacaacccatcaggtaaacaccgtgtatgcaggacttgatcagaaattcaaagagtccgcccacgccaatgtttttatcggaaccgtcgaagttgatccaaccatccatgatctggtaaaagaggtaacatctttccagccatccaaaatctatgtaacaccttttatgatcgtagcaggcgatcatgcacacaatgatatggctggtgattctccggattcctgggtatgtcagtttgaaaatgccggatttgaagtctgtccgatcatcaaaggactgggtgaatatcctggaatacgcaggatgtatgtggagcatgcacaaaaagccattgattccatgaaataatatatctatgcagtaatgtcctataaagcaaaaaggtctgtacccatcgggaatatttacagtttttctctgcctgtttacgcagcatggaactgtatcattctcaaaggtccagacctttttccatattcatttataatgtacgcttctcttttattcagttctcctgcctctttttacatatctgaattcccataagtaaaagcactgggaatacgattgccgcaagaattcccattctcagattattccccacactgctggatacaaaacctgcaagtgtcggaccaccggagcagccaaggtctcctgcaagagcaagcaatgcaaacattgccgtacctccacctctgatggatgccgatgcaatgctgaatgttcccggccacataattccaacagaaaatccacagactgcacaggtcatcatcagcataacgacccagaatatcttcatggagcagagtcctttaatagaaagtcctttctctccttcttcatgcagggaatagatcggggaagtcagaaatacgattccattaagtaccggaatgaccgcccagatgcgtgcaaggattttccagttttctattccaaaagtgctgaagaaaatcgtagagatcagtaccactcccacatgtccccagcattaaacggtcttgttttaaatctaaatacaattgtaaacttttctatttttttagttgacattatcttttctttcttttaaaattgtaaaccataaagattttggaggtttacaaatgtcaaagacgaaaactttaatctactgcagtctttttactgcgctgattgcggcgggggcttttatcaagatcccggtgccggtggttccttttactttgcagtatctgtttacgatgcttgcagggctgctgcttggttctaaacgtggaacaatctctgtcgttgcctacatgcttctggggcttgcagggcttccgatcttctctgagggcggcggtctctggtatgtctttaagccgagttttggctatatcattggattctgcctcggaacttacgtgacaggacgtatcgcagaacatctgaagaaaaagacgatcttctgctacctgctcgcaaacctggctggacttatgatcgtctatgcctgcggcatgatctactactatgtgatctgcaattatgtgatcgacacaccaatcggaatctggccgctcatcctctactgctttcttcttgcagtacctggtgacatcgctttaagcatccttggggccatcattgccagacgtgttcgtccggtcgtgatccagtacctttctgattccaatacaactttattacatacggaggagacagcaaaatgaacccacttactttagcccaggaaattattgacggacgcaggatcacaagagaggatgatctttccttctttctcacctgcgatctggatgaattatgtgaaggtgcagaccgcattcgagaagcctgtatcggagacaaagtagacctctgctcaatcatcaacggacgcagcggcagatgtccggaagactgtaaatactgtgcacagtccgcacaccaccacacttcctgcgaagtttacaattttcttccggaggaaaagatccttgaagcctgtaagatgaatgagtctgaaggtgtcgaccgtttttccatcgtcaccgccggaaaagctctgacaggaaaagaattcgaccaggcaatccatgcttacgagaccatgcacagagaatgcaagattgacctctgcgcttccatgggatttatttctgccgaacaacttcaccgtcttcacaaggcaggtgtgaccagctaccaccacaacatcgaaacctcccgtagaaatttcccgaatatctgtaccacacacacctacgacatgaagatcgagaccctcaaaaaagtcaaagccgaaggcatgtgtgcctgctccggcggtatcatcggcatgggtgagacctgggaagaccgtctggatatggcgatcagccttgctgaacttggcatcgattccatcccgatcaatgctctgatgccgatcccaggaacacctctggaacatctaccggaactttctgagccggatatcctgcgtacaatcgccttcttccgctatatcaatccggaggcaaacatccgtctcgctgccggacgcgcacttctcaccaacgacggagaaactgctttcaaagccggagcttccgcttccatcaccggaaacatgctgaccaccgttgcatgtgcgacgatccgaagcgaccgcaagatgctcgctgacatgggacgtgacgtaactcctgaatactggaaggaagtgtaaaataaaaatgagcaaagcaatttttctcaccggaaccggaacagatatcggcaaaacctttattgccggactaatcgtaaaaaaacttgcagaggcaggcaaaaatccagcttactacaaagcagccatgagcggaaatgaccgccggtcagacgaaagcctgatcccgggcgatgcactttttgtgcgacagatgtccggtatctcacagccgcttgacgaaatgtgcccttatgtatatgaaaatgcctggtcaccacaccttgcatcccgcgtggaaggaaatcctgttgacctcgctgttgtccgcgaaggttttgcgaaagtcgctgagaactatgactacatcaccatggaaggaagcggcggaatcctctgccctctctgttttgatgagcataagattcagcttgaagatgtgatccgggaatttaatctctccagtatccttatcgccgatgccggtcttggcacgatcaacagtgttgtcctgactttcgaatatatgaaggcacacaaccttccgcttaagggcatcatttttaatcattaccatccggggaacatcatggaagaagataatatttttatgtgtgaacatatgacagggcttcctgtgcttgcgaaggtacaggacaatgccacagaacttgaaacagatgcagatgtgctgagtgcactttatgacgaggtgaagatcagatgatatggtatccttatgaacagatgaaaacaatgaaagaaccttacaggattctggatgcagaaggcgtgcatctctacaccaaagaccagaagctgatcgattcaatttcttcctggtggtgcatgatccacggctacaaacatccggagctgaccgccgccatcaaagaacaggctgaccgtttctgccatgtaatgctcggcggtctcacccatgaaccggtagaaaaactttctgataagcttcaggaatttcttccgggtgacctggactactgcttcttttctgactcgggaagtgtcgcagtagaagtctctcttaagatggcactccagtacaacaccaatcagggaaggaaacgccctctggtgctggctctggaacatgcctaccacggagacactttcaaggcaatggaagtcggagatgacgaagattatcatttcgcttttgacaaaaaagaaggcgtcgttcatatcccgacagagatcccggcgcttgaggatgcatttgaactgtatcatgaccggctgaactgctttatcgtagagccgctgctccagggcgccggcggcatgcggatgtatgatatttctttcctgaaacgtgccagagaactgtgcaatcaatatgatgtgcttctgatttttgatgaggttgcaacaggattcggacgtaccggaaaccgctttgtagccgaccttgtccttccggacatcctggttctcggaaaagccctgaccggcggttatatcggacatgctgtcaccgttgcaaaccacaaagtctttgacgctttttatagtgacgatgaccgccttgccctgatgcacggtccgacctttatgggaaatccacttgcctgtgccgttgcacttaagggaatcgagatctttgaacgtgacgattatatgagcaagatccggcatatcgaacagatttcccgtcaggaaatggaaaatttctctgacccgcgcatcaaagaagtccgtatcatgggcggctgtacctgcgtcgaagtccatgatccaaagaccctggaaggtttccagcagtttgcctatgaacgcggggtcttctgcagacctttcttaaactatatgtattccatggttccttatgtgatctccgacgaggaactcattcagatttttgacgtaatgaaggactggtttcactgaaaccagcccttcttctcttcaattctattcaacatatctaacagcgatttcttttattaacaaaataattcaggattcccccaccaacaatgatcacaacggcgactgccacgactctcttggctgcttcctgtggaagctggctctttgaaccaatagaatccgaataaaaggtcagcgtatagtcaatctcatgaggtgctcccattgctgttgtatctgcgatcaccggcattccttcatccatactgagcaccggaatctcaaaaacagaattcataccttcttcattggtcggaagatatttctctccgtctacgatcatataatcataatttgaactgctccactggatctgtgcgtaagcctgaccatccttcacagtcagaattgtcggcgatgtcacacttgcctttccgcttccgccctcaagatccacctgaatggaatattctccatcctctttgtcaatatccatgcctgccgcctgacagatgcaggaaaaagctccaatgccgataaatacagcagcaatcagacttgaaagttttcttttcatttctctactccatttttttctttttaaacattgccaaattttatctatagaaactatgataacacagcaaatcctacattgcaaacactatacaattctagtataataaaaaagatatgtctgtgaatgagacttcacagcataatgtaaatttaagatcatttcaaaaatgaattcaggaggttttatcaatgaaaggtacattatatggagtcggcgtcggacctgggaatccagaattaatgacattaaaggcagttcgcatgatccgtgaaaatgagatcatcgctgtacctggtgcagacgttaaagaaaccgttgcctataaaattgcagtacaggcagttccggagctggaagaaaaagaacttcttccaatctacatgccgatgacacatgatgcaaaggaacttgaagaaaatcatgcaaaaggcgcaaaagctctggaagcctgtcttaatcagggaaaaaatgttgttttcctgactcttggtgatccatgtgtatattctactttttcctatctgcagcatcgcgtagaggcagacggatatcacacagagctggtaagcggaatcacttctttctgtgctgcagctgcacgactgaacatttctctgtctgaatggaacgaacagcttcatatcgttcctgctgtccatcgtcttgacagtgaactgacagaatccggaaactacattctgatgaaatcaggaaagaaaatgaatcaggtaaaggaaattctcgccaaaagcggccgtgatgtcctcatggttgaaaactgtggcatgccagaggaacatatctatcatggagttgaggaaattccggatgatgccggctactattctctgatcattgcgaaggagcacaaatgatcgaaacaaagaatctgacaaaaacatttgataattttactgctgtggattctctggatctcaaaattgagaccggagaattcttcggtcttcttggaccgaatggtgccggaaagactacgacgatcagtcttctttctacgcttcttcttccgactaaaggagaaatcctgatcgatggacagaagctgacacgaaaccgaccggatctcaagcgtaagatcagtgtaatcacacaggagtactccatgcgccaggacatgaatatggacgagatcatggaatatcagggacgtctttatttcatgccacgcaaagaaatcaaacgtcgtacagaagaacttctggagttctgtgatctgatcaagtttcgtaaacgaacagtccgtaagctttccggcggcatgaagcggaaactgatggtatgtcgggccctcctgacagatcctgagatcctgcttctggatgaaccgaccgccggtatggatgcgctttcccgtcgtcagatgtggaatctgctccgcaaattaaacggcaaaaacctgaccattcttctgactactcattatatggaggaagctcagaatctctgcagccgtgtagctctgatggaccacggtaaactggaggaagtcaatactccggccggactgatcgacagtcttggaaattacaccgttgatgaatttgccggagacgaaactcacagtcattattttcacagtcgtgaagaagcaattgcctatctctccggtctttccggacaggcttctctacgcgaaacaacgctggaagatgtgtttgttgaacgtgccggacgacatctgatgccgtcataagggaggatctagttatgggaattattacaattttatgggaaaaatgggtcgaatttcgaagagatttctacaagatcacgctggcggcaatgattgccccactgatgtatctggtcgtatttggaatgggaatccagacaatctcacatggagaaccttatctgaactttctgatcccgggtgttgtttcactgacgacaatgaatggaagctttaatgccattgcacagaatctgaatgtgcagcgactttatgagaaggctttcgatcaggtactgatctctcctacaccgttatggcagtttattgccggtcagatcatcggcggaagccttcgtggtttttatgcaggtggcgttattctggttctgacaatgccgatcgacaccggactgatctttaacggctggtctttccttgtcatgttcctgaatggagctgttttttctgcaatcggtgttgtcgtttcattccttgccaaaaaccatgcagatgtaccgcgtttttcgaactacatcatcatgccaatggcatatctgtgcaatacatttttctctacagaaaagcttcctggttttcttggaaaatttatctctgcactgccgctttcccagacaagtcatatgatccgaagcatctctgcaggagagggatttgcaatgtcgggaattgcgatacttatgacatatctgatcgtttttacagcgattgcatcatggtttatctataagaaaaagaatctttaaaagataactgggaattcacacagtaaatattccgaagaagggacagtttctgcgccaaagctgtcctttctctgaacttactgctgaaattaccatcttttaggtagatagcaaaaataacacttgtctgagccataggcgagttagcaatttttgcgaatgctttttgcaggcaggttatatcttagtacttccggactccgaagccttgtgactgaacagatcaggaagcttttcgtgaattatataaatgtaattctaaagttctaattttcagcagctaattcagaaagatatctttcaaaacaaattccttcattccggtcggtgccttcaactaccgcatcatgaatccccttcgccagaaacttcacggccctgtgcacagaatccaccgtgtcgattcctttcaccataccggcactcaaaaccgatgcaaacagatcacctgtaccagaataactgccaccctcttttgttgcagtcacccaggtcgtattgtcatcctgacagatcaggtttcctatctcctgatgattctccctcgcaggaagatcaattcctgtaataaccacttccgtatcaaactcttttgaaagttccttccctgtactttctgtgaatttcagcaatctctcctcatccataagtgatagctccttccacaatacatgtgcacgctgtgcgccatataataacaatagagcttctgtcagatttggtgttatcaccgtcgctcttctgaccagaaaacgcattttttcacagagtgcctccgtataaatcgggtactcttctccattatcccccataacaggatctataagtatctttgtgtcttcttttgcaaactgttcaataaattcaactgctttatcggcctgacgtgcgtctgccaaaaatcctgtatagattccatccggataaaaatccatcttcttccactcttccataatcgcatccatacgatccgtataatcatcacaataataagaagggaaacccgtctgcgcacttaataccgctgtcggaagcggacatgcctggattcccataacggaaatcaccggaattgctgcagtaagagaacattttcccattcctgataaatcatttaataccgcgatctttttcaatctgttatctcctcgtcttgcattttctcattatctgatttagaatagcatctaagtgtatttataaaaataaccacttttattcatttttcagaggacagtttatgagtttatcttttcattccaataaagaatgcctgtatcttcaggtatatgaacattacaaaaatctgatcatggaacggcgaattcctgccggaagccgcatgccatctcttcgcaaatgttctgcagaactgaagctcagccgtacaactattgaaaatgcctatctgcaattggccgcagacggctacattgttgcccgtgcacaaagcggctattatgtaactaatattgcagagcaaaagccagtctccactacctcctggcatgcgaatctgccttcaatacaatatgactttgcttccaacggtgtcgatcatgaaagtttccgttttgacctctggcagcgttatatcaaaagcgcacttcgtcagagtgaccgtcttctctcctatggagaaccccagggtgaagccgatcttcgtcaggtacttgctgactacatccgtcagcgaagaaacgtcaactgttctgctgacgatattgtgatcggggccggagttcagagcattctgaatcttctttgtcctctgatccatgaccgaaaaaccgtttcttttccaaacgcttcttttgtgcagggaagtactattttttctgattatggttttgaagttcaataccgcaacaaagactgtgacgtaatctatgtttctcctgcacatatgacgaaatggggagagatcatgcccgtcagccgtcgtatggaactggtacattacgctacagcgaaaggcagtctgatcatcgaagacgattttgagaatgaattcgtttattttcaacgtccaacaccttccctctttaatcttgccggaggacatggcgttgtctatattggttctttttcccgtctgctgcttccatcgattcgcttaagcttcatggtcttgccgccttctctttccagaaaatatgcagctgttgcagaacgctacagccagactgcttccaaagccgaacagattgcactctgtcagtttatccgtgacggtcatctgacttcacagacaaaaaaattaaaaaagctgtatgctcagaagctgaaggctcttgaaaacgaggtgcgaaatacattcggcagcaactgcacgatccagaccggtgccgcaggaacaagtctggcattgaccattccttatgccagaacaggtcttgagctaaaaaaagaagcccgcatgcatggaatgtctcttctgattcttgaagaaaatgcagctacgatcaccattctgctctcctgttcttccattacgacagacgattttgcccctgcctgtcagcttctgtcccgacttcttaataaataatcacaaaacacctgtccggcatttcatcatccaggcaggtgtcagtatttaatctcttcgattatcgatcatataaagcaatgcgttacagatacaggctgcaatattacttccgcctttacgtcctctcgcaactatataaggtgctcccgaatccatgatcagttctttcgattgtacaacattcacaaatccaaccggaactccaatgatcagttccggattcagttttccatcttcgatcagttcatagagtctcaccagtgcagtcggcgcgtttccgattgcaaagatcagttttttatcgagagtagccgctttgtccatgcttgctgtcgcccttgtggttccgttctcttttgcaatctttgccacatcctcatcggacatgaaacaatagacttctccaccataacgggccagtgcacgtttattgattcccgcctttgccatctgcgtatccgtaacaatgcaggcgccctctttaattgctttcattgcacgctctactacatccggcgaaaaacagaggttatccgcataatcaaaatctgcgcttgtatgaatacaacgtttgacaataagttctgttccgggaagcagctgtttatcaccaagttcctctgtaataatctcaaaacttcttttttcgatctccattggttttacattttcaagctctactttcatttctctgcttctccttctgcttcactttcttccagaatatcctccacaccttgctcaaggatctcatagattttcttcatatccagatgtttccgaagttccgatgccaggatatcatactgtgtttctttgaatgcagcaaaatccacgccttccatctctgacacatcaataccttttcttatgcctactgcacgaacaagaccaagtgcaacctcttctttatcaaaaatgccatgaacataagttccgcatacattgtgataaaatgttccttctgtcttctctgtccctgtcacagtatcacatgtagaagtacttgctacagccccatttttccaggtactctcacccatatgaatctcatatcctgtaaattctatgtttttaagaggtgcaaactcttcatccagctccaggaattttccgcagacctgcgtacgtgtcttatgttctgcaaacacggtatctaccggaagaagaccaattccacgcatcgtaccgcctgcttccacaccatgtggatcacttaaattttctcccagcatctgatagccgccacagataccaaagatcagtgtaccggatgccgctgccttaaggatcagtgcttccatgccactttcacgcagccatttcagatcatccatcgtattcttggttcccggaagaaagatcacatccggctgcttcaaatctgacggatgctgtacataacgcagcgaaacccccggaatactttcaaacggattaaagtctgtaaagttggaaatacgtggtacacgaataaccgccatatcgatcactccaacttcctgatgacggtcaaagcgttctgtcagactgtcttcatcttctacctgaatgttcatatatggtgcaacaccaacgaccggaatcttacatttctcttccagcattgccacacccggatccagaattgatttgtcacctcggaatttattgatgatcagacccttgatcatttttctctcatcttcttccagaagttccaccgttccatacagctgtgcaaacacaccgccacgatcgatatcaccggcaagaagcaccggcgctttcgccatctttgccattcccatattaacaatatcttcgctcttcagattgatttccgccgggcttccagccccctcaatcacaatgatatcattttcttctgctagcttatgaaatgccttcataatgtcaggcaccagttttttcttatatttaaaatagtctctggcactcatggtaccaagaacttctccatttacaatgacctgagagccaatatcatttgtcggtttcagaagaatcggattcatcaggaccgatggttctatacctgccgcttctgcctgcataacctgtgctctgcccatttcaagaccttcactggttataaaagagttcagtgccatattctgcgatttgaatggtgccacacggtatccatcctgatgaaatatcctgcaaagtccggcagcaagaagactctttcctgcattggacatggttccctgtatcatgatcgtctttgccatatctgttccctttcgtatcagacttatgcctgttcctcttctttcagtacctctgcatgtgccactgccgcttttgtagtgccatcccgcattgcacggatcaattcctgattttcctcatgtgttcggacggccacacggtaatatccttttcgcaaaccagagtaattgctgcagtcacggatcagaaccccctgttccacacatatttcaaataaattttccggtccatggaagaaaatataattcgcttctgacggaaagacttccatgccaagacgctgcagttcttctttgagatattttgcttcccggaataccatctgtcgcccctcttccacatatgcagtttctttcagcgcagcaatacctgccgcctgtgccataacagaaatgttccatggctgtgtcacctgcgtcatcgcatcaagaagttccgtattctcagtaataccatatcccagtcggattcccgccatcgcgtaacgcttggtaaatgccttcaaaagaaacagattgtgatatctggacaactgtgctttcagtgtgtatctgcccggttcctccataaaatcaagaaaacattcatctacgaccaaaaggatatccatttctctgcacacacgtaaaacccggaaaaggaattctctatctatcgaaattcccgttggattattcggattgcagagaaataccatatcaaggtctctgtgcagccagttgataaaactgtcctgcagactgaatccctcttcttctctgagaagtacatgttctacctcacagccacagctcgtaagcgcctgctcatattctgcaaaagtaggaaccggaatcagtgctttcttcggttttactgcctgacacagagaaaataccagttccgccgctccatttccacagatcacagattcggatgccacaccttcatattcggcaattgcttttttcaaaggtgcatatccgacctgcggataatctttcatatattcaagactgtcacgtaccgcctgctttacactttccggcgttcccagtggattacagtttgccgaaaaatccagacagttcttataagtatagatattaccgccatgtacgtgcttcgtcattctttttctcctttttgtgtcccgttacagaaacacaacgcggaacaaaacacagatgatcacgcccagaatcgccgttgcatacatcaggcggttcgcataacgaatatcttctgtctctatttcccgaatcgcgtctccaattgtaggtttctcatataattttccaaaataatatgcatttcccgcgagctgtacatccagtgcaccagccattacagcttctgtctgtgccgaattcggactcgcatgatttctgctgtcccttttgaaaatacgggatgcgtttctgctgtcaagtccgatcacaaaagctccggcaaccatcagccagccggaaattctggatggaagataattggctgcatcatccagtttcgccgcgcatcttccaaaatacagatatttatcatttttatacccgagcatggaatccatggtattgattcccttatacaaaaacattaaaggtacaccaccgattgccatatagatcatcggtgcgatcacaccatcagaagtattttctgccacagtctccaccgctgctttggtcacaccctcttccgtcagctccgccgtatcacgtcccacgatcatagaaaccgcatgacgtgcatcctcaattgttccctttttgagtgcatcataaaccttcatgctctcatcacgcaatgatctggtagcaagcagctgatagcaccaaaaggtttccaaaagcacacctaaggccggaagatgaatatacagaaaatacaaaacaaatgccggaaccagtaatgtaatgacacagatcagtattacttcaaccagtcctccagccagttcacctttttctgttttgggaaatacttttctgattcccttctcaaaactggagatcagcttcccgatcaggcacaccggatggtacaaccatctgggatctccaaatatcaaatctaagataaaccctgctgccagggcaattgtatggtatgtatatatcaactctgtcactctccccgtctgctgtggtatttcatgcattctttaagaaaagcctctgcaacttttggatttccataataataaagatgtggaaatccagccagcatagtttctgtgccatgaatacactcccagtttctcacactttccggttttgctgcatgaaatgctttcccgcagttttcagaatcaaaataatgaaattcatgagcagggatctctcctaatgtctcacatcccaaaactgaatgattctgtattaatgtcacatagccaaagcgattcagacgtggtgtacgatatgccctgcccggaagcacgcctgccatgtggtaaaattttttatccattgcttccatttcttcatgaagatacataaagcctccgcattctgccatacatggcataccaccgctaagtgctttttgtatttcttctctcatagatgtatttttttccagttcttttccatttaattccggataacctccatataaaagcaatccatccagtccagccggtaatttcttatctctgatcggagaaaagtgtacaagctctgcccccatctttcgcaaaagccggaaattatcttcatagaaaaagcaaaatgcttcatcgtccgccacaccaatccgaaggggatgtttcagacagaaatctatccgaggttctttcgcagataattctcgtgcactttctgcaagctgcaggattgcatcaatatccagagttttttccagaacctcagccaatcggtgaaggttttcttttaactcagggatctcatccggaagcactaaccccagatgtcggctctcgatcacacaatcatccattttgggaacatatccaagaacttttatattcagttctttctccagaagttctttcattcttggatagagcattggtgacatctgattaaagatcacaccctgtatatgactgtccttcctgtattccataaagcctttcacatatgctgcaagagaaacactcatacctctgctgtttacgatcagaatcacaggcgtatctgtaacagacgccagatcgtaagcacttgctttcgttgttgtccctgcaacaccgtcataaaatcccattactccttccataacagaaatatcacagtccgccgcattttcacagaagaggtattttgtagtttcactgtctgtaaaaaaggtatccagatttcttgattttgcgcctatgacacgactatggaacatcggatcaatatagtccggcccacatttaaaagatgctgttttcagaccacgattcaccagtgcctgcaaaagtccacatgtgatcagcgtttttccgcttccactggctcctgctgccaggagaattcttgccgctttcatacaaaattctcctttttatgcgcctgtatggtaataatataaataggattttctcccatcatcatatgatatctaccgatttctttggatctggacacaccaagctgcacaacttcactctcccacttccactcgctgcgttctgtctgcatttcctttatgcaggacaaagtttctccgaccgtttcaagtgtaatacaatttatgaccatacgaacatgtggatttttttcgagaagaagttccacaatttctttcatatttccggaagatccaccaataaaagcatgggtaggagccggaagttcttccattgcttcaggggccgttcctgctatgatcctcatatgatctaacgcaaatttctttttattttcctcgagaagcacaagtgcatcctcttttttctcaatggaatatacgcttccctgacttgcacgaagtcccatctccacagatacagaaccagttccggccccgatatcatagcagaccgaatcctctttaagacataactttgccagcgaaactgttcgtacctctgtcttggtcatcggtgcttttccacgggtaaatgcatcatctggaagtccatgtgtggtcaatgctgtttttgcatccggattccaggcacagatcacactcaaggcatctcctctgtaatctgtaagttccctcgcctgttttacaaatattttctcatcctcataagacagattctccccgacataaagctgcacttcacccattccataatccgtcagtttctgtgcaagatgtgcggttccatctgaagtgccaagaattgcaaaaaccttctgatttgttcgaatcagggataccagattgcatactcttccatgtgcactgacaatctttgcatcatcccatgaaagaccaatttttgacataaaataaacaacagaggatataccgcagatgatttcggcatttccgtccaaagctttcaaaagtccttttgccccactgtaaaaaccgacatcaccggatagtgcgatcacaactttttcatattccggatgtttcttaatatactctgcaatctcagcacttctgtattcataaaagacatcctgtcccggaagtgccactgcatctgccatccttctggcgcctatgatcagatccgcctgttccactgcctcattgccctgaatcgtcaatgtttccttgcttcccattccaattcccaggagaactacatgtggtgtcggctggaatccaaatttctctggcagcatacgtttgcattcttttacagaaattcccttttcctgcaccggacggccaatgatcacaggaattgcgccacattctgtggcagcctgaatcttttcttcaaatccgcctgcttttccggaatcttttgttaccagatatctgcagtcatactgacgcagcatggcagcattcaattctttcgaaaaagggccctgcatggcaatcagatttttgccctcgaatcccagcatgcgacaggtttcgatcacattctgaatggaaaggactcttgcaaacattctttcctgataacccggaatttctgtataagcagaaagttccttactgcccgtcgtaagcagaacatttcccgatacatgtttcagataatctactgctgcctctgtattttctacataaactgcatctttgtgaacgcctccttcacgaaggactctcacataagaaactgctgtgttttcacaggcctcacggatatttactgtcacttctgccgcatatggatgtgttgcatccaaaaccagttccggtctttctgctgcaaaaagctcctgcatctgttctttgtcaaggcgttctgcacgaatcgataaaaattcattttcttcaagagatctggatccatattccgtcgcgacacaggcaagtacagatactttattttcactcagaaaccggctgatttcatagccttctgtagtaccagcaaaaacaattgctttatacattccgatatcctcttggagttaccattttgccatttatttcttttgtctgggaatttccgataaatactgtggtgaacatatcaacctgtctatctcgaagttctttcaatgtcataacctgatattcttccccttctcttccgatattgcatactgttccgcaaactgtttccggagatttgtactgcatcatcagatcgcaggctttctgtaaataatcatggcgttttttactggaggggttatagagacagattacaaaatccgcctgagatgcaccaagaagtcttgcttcaatcttttcccatggagtcagaaggtcacttaagctgatcaggcagaaatcatggatcagcggtgcaccaaggactgccgctccgccaagtgcggctgttactcccggaacgatctccagttctacttccggatatttttctcctacttcatacatcagtccggccataccatagactccggcatcaccgctgcagatcatggaaacccttttgcctttcatagcctcttcaaaagccagcacacatctgtccacttcttttttcattggtgtggtcagatattctttatctggaaatgtatctttaacaagatccacatataccgtatatccaataatcgtatcactgtctttcaaagcattcattgcaataccggtcatctgatcacagcctcccggtccgattccaactacatatattttattcaaaatgaacctcccagttccggagtgcaagcgcggttgtcacgccatttctccctgtcttatttttgatcaggcggccctgctccgcacccaggactgcacttcgctcacagacattattcacgcctgtgatcttttttacaaattcggaaggggtaaattccccctctgcatgactcagctcttcttcctcaaatgtgataaacgggattctccagtcttctgcaagtttttgaagccccacttcgtcttttttgatggaaatgcttgtcagcttctctactgcctggctgtatatatccgcgtccgccagacagacactagcttctttttcaattacatctgcttctttattcctgcggcagcccattcccagtgtcaccaccctgggaatgatctgcaccgtggatgtaaacggcttacaggttggatgaatggttactgcaattccaatctccggtttatcctgcgtgtcttccgaagactcttccaggccttccggcaactttcctgtccatggaaattcactgtaaaatccgacaggttctcccgcaagcaaggctgccgaaacctcctttgccgctttcatattccgaattccacagcaattcttttttgcaaagacatccactgcaaagcgatgatgaagatctgtcgctgtcgttacgactggaactgcacccagaagctccgcaacttccagagtcagttcattcgcaccgccaagatgtcctgataacagagatatcacaaactttccacattcatcgatcaccagtaccgccggatcagacttcttacttgctacgtaaggtgcaatgctgcgcaccgcgattccacaggctccgacaaaaataatcgcatcatctgtctcaaaatggcggcctgcccagattcctgtactttccgcaatcgaatcatcgagatatttacttttcttataaatttctgccgtataacctttgccctgaaggtctttttgcaggtcttccgcagtcatatatcctgtaagactgaaacaaatgattgaaatacgcattatttaattctccatttagatcggattatttactgcgcgttctcactctgttgcttcacggaattcggtagtgaatcccggatcatacagttttgagcgatcatagtgagctgcttttacagaatccccgatgatcatcagtgcagtctttgtgatattgttttctgcagcagtctgtgcaagcgtgcctactgtgcagacaaatttcttctcatccggccaggttgccttgtatacaattgccgccggcgtatcagctgtatatccgccttcgatcagtctgcggctgagttcttccagcataccggtgcttaagaaaacgaccatcgttgcctgatgagctgcaaatgactgaatgctttctttggatggaaccggtgtacggccttccattcttgtgatgatcacactctgtgagatatccggcagagtatattccagattcagggcacttgccgcaccgcagaacgcactgacaccaggacaatagtcatacataatgcccttctcatccagaatatccatctgctcacggattgcaccgtaaatacaaggatcacctgtatgaagacgcacagtcatcttcccttctgcttctgctctctccataacggagatgacttcttccagtgtcatcttcgcactgttatgaatcgtacaaacatccttgctgtattccagcagctgcggatttaccagcgaacctgcatagatgatcacatctgcctcctccagatactgtttacctctgactgtgataagatccggtgatcccggtcctgctccaacaaaatgtaccatgtttttattctccttttttatatataattgtttaatttgtcatttactctcagctgaatttattttacggatcagttcttctgcatgctctgtctggccaagatatccaaattcattggaaaagatcactgcacccagaaggatctgctgataagaacgatgatccagataaaactggatatgtcgggtcacatcctccatcgctttctgtaaaatatgataacgatcaagcacatgcagggcctcatccgtcgtgttgcatgccagaatctctctggcacattccagatctgctccggagcgtattgctgccgcacacagaacctccatacgtccgtctgcgctgtgtgaatgtgtattcatgattccggcagcaactttgacaaatttgccaatatgcgaaataaaaagaatcccctttactcccatgttcactgccatatcaatggtttcacctacataattactgcacttgatgtttttttcaaaaggaagattcatatgctcccgaaggtaatctgccccataatttcccggagtcacgatcagatactgttccccctgtgaaaaatgctgtttcatttctacttgaatactctgaatcaaggctttctcactcataggttctacgataccggacgttccaagaatagagatgccaccctggattcccagacggggattaaaagtctttttcgcgatctgttcaccttctggaacagaaatcgttactttcaggccaccctcatagtggtatcgatctgctgcatcctccactgctttcaggatcatggcctttggcacaggattgattgctgcttctcccactttctgtgaaagtcccggacgcgtcactcttccgacacctttccctccatcgaccgtaatctcagaggatttcggacatttttccactctggcatagaccagaattccattcgtcgtatccggatcatcccccgcatctttacgtactgcgcagatcactgtatctttttccatacagacgtcatgcaattccagatggagaagaattccctttggtgtcataagatccgtctcgttctgtttctgacctccgagaagcatttccgtggcaccttttgcagctcccgccgcacaggatccggtcgtatagccgaaatgaagtttcttttgatttttaattacataataatcttccagtcctgttttatgtgccataacttcctccttcacatatgccattttattatattattttgccaaaaaaatgtcaatgaaacaccttttaattaatcttacattcctcatttatccggaataccttttaaaatatttctgcacaaaaaaaccagcccactttcggactggtcttttgcattttatgtatcttttgcattttatgtatctttttaataaataatgatcggatatccgccgtcaatcgtattatagatcagtgctgcctgatctgtcggaaggttgatacaaccatgacttccggcgccacttttatatcggtttcctccgaaagaagactgccaggatgcatcatgaagcccctgcccatatacaaatggcatccagtaatttacttttacgttgtatccatattcctgactgctcaggttatatggacttgccttgtaggcaatcggccatgctcctctgtatgtctccctgccagcttttggtgctccactgacgatatctgtttctgtcacaagtgctccatctttgtacagccacagatgctggttatccagacttacttctatatagcttccgttcagatcatctgcaccgttacgctgcatgccactgatgctgtataccggatctcgtgtaactgcagtaccactcgcaagatctgtcagcaactgctgcacttctccatcctgatcgatctgaaatccatattcattatcggataccgtgacatcatttccataggatgtgtggaatgtacgtggaacatagatggtattatacttcgctgcaagattctgtacataagacttcactgcttcctgatcaatattcaggctgtcatctgtaatctgcagccatgtctcgattgttcctgcatcaattacttccgtcgtacttcccaatgtatatgtaactgtagtactgcgatatttattcaactgatcattcagtcctgtaactttattctgcatttcatcagaaaccgttacagaaggctgctgataaacatttgtatccaatgtgatctgaatatccccaccaagaagcttcagccgaaaattatcatctagcatctgatctacatagctttgaagtctggtctcatcaatttcatttccctgcacatcattgaccagaacaaactgcttctgctgttcgtcatactgaaccgctgcatccacggatgccgtacgctctttacctccaaaattagaagacgcaagagctttcttttcctgttcttcattcttctggatctgatatgcgatcttgtaatcttcctgcgtggcaaagatctttctgtttgcttcccgcgttgtctgcaattctgtaagctcacttttaagtgctgactcatccagatcatatccaagttcactcaccgttgtctgatagacatccgagccaccttctttgaactgtaccttacggctgcgaaaagcatccagaagcttctgttctgccttatctgccgtcagcgtggaaacatccatcccgtaaatagatatttttcttccaagtgtattggtatctgcaatatgtatgtaagtaaaaagccccgccgtaagaacaaccacacctccgatacatacgcccaatatgattttctttgcttttctgctgagcttaaatttgtctgccataatctctttcctcttatctgctgtattgtcaatttatgcacgtattctgattcttattatattacagagaaaaatggacttctgtaatctgaggtttctgtttatctctggcaataaattattttaccttttaataaccagaactcttctcataaggtgttgtatagattttcaggaatttatcatattctttgttactgtaaaaatatcttctgttatgacggctgatatcaaggcagtcaaaaccctttcttttgagcagtctgtatgtcttttcatatgcacttcctgtcattgtatttaactgccacagtgaaaaattaagcgcccaattaacaaatgccctttctaaggtatcatataaacctctgtcttttagctccttttgcatagccaaaagcgcaatatagaaacaatcccatgatttctctcttgtacgcgacagagatgttctgacattgactctctgatggatcaagacctcatctactgtagaaattctggaagcacaggcaagcgcaataaaaacaaagagcatatcatttgttgttcgaagattctgatacttgattcccaatctcctgacatactccctctggtacaatttatcccatggccaaccattaaacattctaaaaatattatttcttacattttcatcagttgctgcaaacggctctttttccggaaaatactgcttccgaaatgcccatgtgcattttttgtatactttctctgtatgatcatagaggtctgcattaaacacacatacttctgcctctgtttcttccgctctgtcatatgcggctttcagcatatttttctcaaagaaatcatctgcatccagaaaagccaggtattttcctcttgcaacatccattccattatttctggctgctcctgctccctgattttcctgatgaatgactctgatcctggcatctgttttttcgaattctttcagaattaccagtgatccatctgttgacccatcatccacacagataatttcaatctctctcagagtctgcttcagcaggctgtttaatccgtcttttaagaattctgccgcattgtataccggaattatcaccgaaaccgcaggtatatcattactcatatctattcccctttgattaatgcaacatttttttcagctttcgcggaacaaaggtaattgctcttccaatttttaaagatgaagaattttccatgtcatctatttttttctgaagctttgtcaccttgttttcgctttttttcaatgccttcgccagttctgcttcgcttccaaacctgagtagttcttttcgaaatgtttcatcaaaaaaagcatccatatcatctactaattgattgatatctgtccattctttttccgtaaaatattttttgtcaaaaagtcccctgttcttcgcctctgaaagttctttatgcatcctctccaaaaaagcatatttgaattccattgtaagtctgaacagattccaccgataagatatatatttcaaagatataaccggtttctccagttcttcttttagctccggtcgtttttcaagaaattcttcaatagatttaaattcatcacagatacaatatattttggcagccgcttttaccgatgaatttgcattatctgtgcgataatgaaggtaggcatcacgaaccagcaatgctctttccgcacttgcccatactttaaacgcaaatcctgtatcctgataggaagcacccggtgtttccgcaaaagatacatgattttccaacagccattctctccgataaatcccgctccagatacatggtctcacacgaaagatttccggatgttccaccggtctgaacacctgatcatacagatcatattcttttagcacttcataatatgtgctctgaggttccggctgcgatacataagaataatagtttgatttcacaacatctgcatgattttcttttgctgctttatataattcatcaaacatattaagatctgcaaaatcatccgtttcaataatgcctatatattctcctgtcgcattttgaagtccaacattcatactatgtccgtaccccgaattcgctttatggatcactttgatacgattgtctttctgcgcatattcatccagaatattccctgttgaatctctggatccatcatctatacaaataatctctatgtcctttaaagtctgatttactacactgtccatgcattcttttaaaaatttttcaacattgcatgccggcattagtatggatacttttgccatcttccattcctcctgatctgtcattatcttgcacgaagctttcgaatgattgctatgcctgtacattttattccgttttttctcatatacctgaatatctttttcaccaaataccccggtgtcgttaatacctgcagcattttgcccacaccggatggttctgttattctcttataaagataaatatcatttacgcaaaaaactctttcagccttcaacagaatacgttttacaaagcatctatctgtatctattctattatgaaagtccgttttttccccgataagtaaatcttttttcaaaatctgcatggatacgggcggtaatatatccttattctttttcagctgatttcgcatttctttccctgttattacctgcgcgtaagagccgcatctgtaaaattcatctgaaagatttttatatcgtttcgcgagttttgtattttcataaaaaactgccccggaaaacagcagaatatccagatgtttcgtctcacatatattccacaactcttccaaagcaaatgaagtgagcaaatccccactattcataaaatacagatatttcccctctgctttatttaatacgtcatccccgcgtgttatctggccgggctttgtctgatcgattatctcgatatcatttacgattgactgcgctgaaagtgaatccagcgtttcttccatatatttatctgtatcacctgcagaaataattaccgtaatttttttcatagttctaatctcatacaccatttcgttttttcaatatttatagcatactttgtttactatttaattgcaatcattttccatgatattttttcagtcctctgtcgaataactgccccaaatattaattttctgtcacaaacccataatttttacaccggacagcaattttgtgataggataattttattatgaaatgaaggagaagattgtgttgaaaccgacaaataccaattacctttttaaattttccattgtaacagctgtctataatgtagcgccttacctttccgaggcaattgacagtatcctttcacaggatataggttttctcgaatccgtggagcttattcttgtcgatgacggatccaccgatgcttccggagctatctgtgatgaatatcagcataaatatccggaaaacatcgtcgtaatacacaaacccaacggtggcgttgccagcgcacgaaatgcaggtatcgctgtggcccgtggaagatacgttaatttcatggattctgacgataaactgactcctgatacactttcttccgtctatgacttttttattgagcatgataaagaggtggatcttgtttctgttcctattttttacttcgaacaaaaaaacgaaccacatcgcctgaattacaaatatgcttccgacaaagcgcaggtcattgatctgaccacgcattattcttatgtacagatgtcatcagcatctgcttttttcaaaagagaagctctgaacgatcatacattcgatacctctcttcgttatgcagaagattccaaggcgatcatggaactgcttttagagaatccccaatatggcattgtcccacaggggcgctacctgtatcgtgcccgtacatccatgaattctgccctgaacggttccaaatcgcacagagaatggtacattgactgcctcaagaactacatattctgggcattggatgaggcgaaatcccgtttcggagccattccggattatgtacagtacaatgtcatgtacgatctgcagggacgcttcaaagttgatgaaattccagaaaccgtattgacgcctcatgaaaaaactatttttttgaaaatgctgttcgatgctgtttttcagattgacgaccacatcattcttgagcagaaaaatctatccatggaactgaaggactatatcatgagcataaaaaaagcaccggattccggaactttgcagtttgacgacaagagcgaagatgcctggtttcaatatcccgatctgagtaccggtcacgcttcatcttatcagcttcgtctgacttccatggaacttatgaaacatgatatcctgctggagggtgcagctaagatctatctgcgttttccatatccagccaatctgtttcttcgaatcacaaccggtcatactacacatatggtaaaatgctgtttccgcgaagatccggaacacgtttttcgttttaatggacagaaacttgctgtattcctgaaatttacagcagtcattccatacgaaatgttttctggtattacacatatcgaattttgctgggattgcgatgggcatacgatctgttatcacagtttacaccgtatgtcggaatttcctcttgcatatggacagcaaaagcttcttctgaacaaaaaatcctattatgctacactttcttcgcagatgcttacatttgaagaagccactcctgtatcaaaactgaaaaatcatacactttctgtgcttcgaagggttcggaagatttgttatttaaaataacattcaaaatatttttcttattttcctgttttctttgtattgcaatctttttgccaatgtggtagcattcaattaaacagaattaatttatatgctatatgttgttatttaaaataacattttatgaaaggtaaaaagattctcaatgaaaaaattatctatgacacgacttgccgaacttgtttccggcaagcgaaaagaaaaatccatgactcaacaggagctggctgatgctaccggcatcaatcgttctctgttatcccgtctggagaaaaaagattttattccatcaattccacaactggaaagtcttggagaatgccttggatttgatccggatgaagcatttactgaacagtccgcttcccggttgccatctccttctcctttgaacattgctgtcgcaggcacaggttatgtcggtctttccattgcaacattacttgcacagcacaatcatgttactgctgttgatatcattcctgagaaagttgatctgatcaacaaacgcaaatctccgattcaggacgaatatatcgaaaaatatctttcagaaaaagagcttgacctgacagctacactggatggcgaagctgcttacacaaatgctgactatatagtcattgcggcaccgacaaactacgacagtcagaaaaactattttgatacatctgccgttgaagctgtgatcgaacttgtcctcaaagtaaatccacatgcgatcatggtcatcaaatccacgattccggtcggctatacagaatctgtcagaaagaaatacaatacagcaaatatcattttcagtccggaatttcttcgtgaatccaaagcactgtacgataacctgtatccaagccgcattatcgttgctacagatccggatgatccgaaactggtacaggcgtcccacaattttgcagctcttctccaggaaggtgctctgaaagaaaacattgatacattatttatgggatttactgaagcagaggctgtaaaactgtttgcaaacacctaccttgcacttcgtgtttcctactttaacgagctggatacttacgctgaaatgaaaggtctgaatacgcagaacattattcagggtgtctgcctggatcctcgtattggaacacattacaacaatccttccttcggttacggtggatactgtcttccaaaagataccaagcagcttctcgccaactataacgatgttccacagaatatgatgagtgcgatcgttgaaagtaatcgtacgcgtaaagatttcattgcagaccgtgtattacagaaagccggttattacggttatgatgaagaaaatacttacaattcttccatggaaaaatcagtcactgtaggtgtttatcgtctgactatgaaatccaactctgacaacttccgtcagtcttctattcagggagtcatgaagcgaatcaaagccaagggtgcttccgtgatcatctatgaaccaaccctgaaggacggatctaccttctttggaagcaaagttgtcaatgatcttgataaatttaaaaatctgagcgactgtatcatcgcaaaccgttacagtcagatcctggatgatgtaaaagataaagtatatacccgagatcttttccagagagattagagataaaaaaatcccttccacttacgtggaggggattttttgctataaacgtttaatattctatacaaatattagaactttcctgcgtctgcagcttcctttaattaaacagtaatgcctgcaaaatcaatacatatcgccatttttgttgcctacctgtttcctattcaccaattttggtactttttcagcacttctcagaccgattttacacctcaattccgtcataaacataacccgtttcctgccagaatttcataggtgatatgtaataatcatactggctacttccgtctttcttgaaagctactccaaatgtgagtaatccctggatgattccctgtctcacaaactgaggatctttcttcattactcttgcagctacattcaccggtacattttcgccagtaaatcttggcacttctaaccataccttcttttcttccatttgtcaactctccctccaatataattttccatatacccagtccagcaattttaatgcgatcattcctggtacaagcattaccagcaccaccaaaaagaaaaatccggccagcgctgttgccgcaaactcacctttcctggttttatcgcaccactcagctctcggacatattccttcatcagtatagcacttgccatcgcattcgactcctcgctgccacatctccctcaccccttttctgcaagggcttttccaactgcttccataatgttctctgcctttgctggtccgattccctttactgtcaaaaggatttctcttagctcatctgccttcaatccttcggagtcttccttgccctggttatatgcgttcatgtaataccgcgacaagtagttggacatatcctggtggtccattttcttaatttccttgtacatctttcggttcaaaaccatctgctttgccatgactactcaccctctcttccgtcaattcgatatactgcatcatcgtaataagggtatatccgtccattatttcttccggttcttgtatctctgatgcggaacggatcttctcctaagccatctacttcctttcccatgaatactacaccttttccgctcagcggatgatttttgcatctgaagtgtacaacatcgcccacctgcatctctcttccatctttcgtatatttacctgttttcatgtctcgccttcctctactttccttatgatctttaactgttccaacggaacaagccttgttttattgcacccatatgctacaatggcaacctttttctgctctatatcatttcggtttacaaaatcaacttctactccatctggcctgcaagcactatcacaaaacaattctgctttcagcgtaataagcttcatacctatgacaacgcctacaaatctcttctccactgcctcgtaatatgtttttacgaaatcgctaccgccccattcttccggttctacttttctttccttttcttcagcattttcgtcaacatagtaataaacatcggagtattgttcagagtgccggatatattttccgtccttaattcttttcatataagtattgcactctacaacttgaaacatatattcattattcctgcgtaatttcactgcatatccgcctcctgtctcttgctgctgatctaaacatcataagcagcatttctgatactggtctgctccgatcatgtctcttggctttctttatgcaggttaattctgttccatccaaaacatatacaccaacgtagtgtgggacctccaatgaaatcgttgcgtaaatcttctccggcattaccaggtaattataatctccgaggaaattcaagccatgccccgagcgaaaatcctctacagatgatttcacttcataacagtaaaagtctcctttttctattccggacacagtattattaaccggcttatatctcatataatcaactctgactgcatggtttgtggagtaatcaaatgtcacttccttagcccagtatatccgtggatcattgtacggattgattttcttttcaagtgccagagacaacgtagctgttatctctggtcttctgctcactctttcttctcctttctgtacagttcagatgttccatccagcacctgacgttccttttcatcttcaaaataccaaccatacggctcaaacacctcatatcctttcaagagtgcgtctcctttgtttttattaaagaccaagttgtaatcatacggttcgttgcaaattttcattgaattgtgcaaaataatcatcatctgatgtaaggaactaagttttcccgctgactcatctgctgcttttttctcttctggtgaagattcatagtagctctttttcaaatagaaatctcgcactgtgcttgcataaatgtaactgccaagtgccatcatagcttcccatatcttttcttttacttcagattcatctttaaccgggctgattttccccgaaataatattctccagaaattcttttcttctggcactgctttcttttaatatcgctttgattttcctttttgcctgatccttttccttttgctctttttcccaaggtgaaagttctttctttccttttggaatttttgtaataattctcaagctacgataatatactaagaaaaatttttcttcttctgtctttggaagtttgatctgctccggaacgtctttgtctaactcatactccttaatagtattccattttccgctccaaatttcattttctgctgacttcggggcagccttaatgcctttcttcttcaacatctctttcagtttttttgcattttcatttcgtttagcttctgctgcagctgcttgcgctctgctcaccaagtctcttgaactggttgcttctctgagaattttatccctcgtcttaatatctttcactttttccagttcgtataaatccttcagcgttaactgaaaattttcatcctgctccttctttttaagttcatcctggtttagcttcgcaatatttaacctacggcgaatggtagtcttgctgaatccagttttctcagcaatttgttcctcggtatctcccaaatcaagcataagctgaaatccctgggcctgctcataaattgtcaaatcgctgcgctgcatattttcttccagcatgattgacaactgttcttttcggcttaatccttcagcgatcctgcatggcaattcttccaggcctgctaactttgatgctccatgccggcggttcccaatcaacgcataatactctccaggctgttcttctaccggaacaaccgttaaattctgtaaacacccctgttttttcatcgattctgccagctccgtcaaatctccgagatcctttcttggattctccgggtgcgtatggatgtgatctattccgatataaactatatctcttctttcttccatggcttttctcctcattctcatatatgaacggcggctttccagccgccatatcagttactcagttttcagttttctaaaataagcggagcggaaaccgatgaagccgtgggcgtaagtccgagggttgtacaggttcacgtcgaacacgccagcattggaagtgttgagccagtagcccccgcagagcggcaaatattctccctcagtgctatcaatatagcagtaggcttccggctctccaggatacagagccagctctttcagtgtttcgctctcgcaatcaatattaacatcttcccatctacatccatcgtatccctcttcgtgatcactttcagcaaggaatttgataccgccatcggaaacgcttactctaatagactttccggaatcatctcttaccggttcccagttatctccttcaagggtaagatcaatatccaatgctgcatcgttattctttaccatctccagctgtccgtcttttattctcaggcctcttaccatttcccatacgtttccggacagatcgtgaacgccttccaatgtatgatcgtgggtccatgttgccggtcctgatccggttttggtctttccggattctcctgctgactctccatgttcttccgggtttgcatggtactttccatagttcgtgttgccatgtggcaaagtaccatttttcaagctgaggttcgcaagtaatccccattcagctcttgtcataagatgccatccctctccctttgaaaaacaagctctcgccgcctcatcattggtaattcctgtccatggcttctgcattggcaggctataaggctttccgttaatttcgcagttctcatagacagaaatgtaaatttcatcgtattcttcatctccaatgataaacgctgcatttgttttatcgcttccaccgaacagctccttatttgtcaccttgcggaatctgtgcatgaatgacgggatgccggcattgtcgtaaattgccactactgcgtgttccaggtttccgctgatgaaatgggttggtgtgatctgctcctcagtattcttttttccagaaggtctctcctggattaccggacaaatattgatctgcatatcatctcttgccgcataatccttaattgcttccatctgctctgcaacgaatcttctctttcctttaaactttgctgaaaactcaccattcataaactttgcttttgccatgttcttttcctcctatgctgtggctaattctctattcaaaagtatctcaaatactttgaatccatagataaatccctgcatttctgcctcgattgcaactcccattaccgagtcctctacttttcttttggctgctacatcatcattcagcccgcccattgccttataaaactcttcgtattttgccccaagctcttcgatttctctattctcgattgccgggccttcgataaactggtcgaacagattctttatgtaactgcactctgttctggatcttcccttcatcaggatattttcctgcgtttttactccatggaaatgctgtgcgattaaatcattaaatttcccaagtccttccacgaaagccttactacgtttttcctcggcacatatcttttcaatgtaaagctggcagcctttttcactcagtttccagattggatgttttctctggtttctatacggtctgtacgcaatctcgaactccttcttttcgtcttcggacgcttctgcattgtaaaaccgagaaatccgattgaaaattctcgtgtgcgtactctggaaaatttttgcgatttcccaactggtaagcggctctgcaggttgcgttgttccctctgctacttttcggataagctctgcggcctttccgatttcttccggcgtgatcttaatttcgttcatccttccagctcctttctcaaagcctgcagaagaggatgccaaggcctagctcctctcatgcgcttcacgacttttctcagatcaatctcttccttgctgatgctttccattccgatcagcttatcgctgttccaacggatcagcttatccttgaatccatcggtcaactttacttctccagctgcacactgtttgtcctcgaacatgacccacttttttccattaaggatgcaataaccaacaatcatctcttgtcctcgctttcaatatcaacgctttctcctgggaaacaatttccgcaatatttccataccttatcccctactttcacgaatgtagaataggttgccatatattttcctgtcttcgggtttaatctactgtcgtaaggttctcctacctgcagatatcctgctcccatatttctcggtggcaaaatattcaagaagtaccagtagatatcttcgtccaccagctctccaggcttgcaaaaatcatcccagtttttcccgctttcttcccatcctttaagtgtcttgatctctttctgcttttcttcgctcattctctgcatactccctttcttttattgctatgtagtctttgacatgaaacccattcaaaatgttaattgcctgcagttccgatagtccgcatctcctttgaagttcctgccgcagttctcttctctcgcctgtatcttgcctaccattttccggaagattttctgccaatattctgtattcattggctatttctgctgtgagaagttctggcattatacagcctccagttcttctttcactcggttcaatgcgtatttgccggccggattcaacattctctgccatgccccctgggatggtgcccatttaaaaccgttctttttcaaaacggctctaacatctgcctccggcttttcatcaaaaataatctgtaacctcatagcttccacattctcaacaaccttaaacagctcaaattccgtttcttttgttcccttttccttgactgctttcaagcttttcaccctttcctctactctatggatatttgcgttgttgttctgcagggcgtatgctggaaatccaactcttcccatgaaatccggagttctcagttcctggatctgctcatcggaataccccaggattttaagctcctcatctccctttttggtattcttcaagcggatggctttattgacagctctcattctttcctggttttcttttaaagcatccagcttctcttccagacgttctatagcgtcctcatctgaggacttgatgatatcctttcctctcaaaatccccttgatcttatccaggattttctgcgtctcagtataaaactgatggttcttctcccaagcctgcacttgtttctcttttttcttcactggaaaattgccagcacccgaaatcataaccgaaggacatctgcaaccgatattgctctcccggttcatgtactcggccattctctttgaatatctctttgccaatgcttcaactctatccgtttccctcggccttgcttctgcaactttctcggccaagtcataggctttatcgacatatcctctgtattcttctgtcttactgcctaccttgtagtcgctcatagacatcatatcgtgtgcgattctggcctgttcttcgttgattgtgcaatataatctttccatttcagtaccctccctcaaactctgccattttctctctgttgaatttcattgatggataaatacaatatccgctacgtctcgttcttccagtcgattttgccagccctttcgcctccaagaaatccactacccaagggcaattatttgtatccacatacgcttcattttctgctaatgctgaatcgcacagacaaacggtaatccttgcaactggcccctctcttctactgaagatttcaactgcaatactgccatccatctgatactgtcctactcttaatgtgcaatctgtatatgttgcgtaacttgtcttaacctctaataatgccatgctatattcctcctaaaattatgctgtgatcggctctctgtgcttttccattctcacctctgctcttcctgcaagattctctcggtactctctgaggcttctctttgcatctgcactggtgtattcgctgttctcacactcccagccatatcctcagtttgtcattatgtcccaccgatcctttgtctttctctgatggctcattcgtactcctttctgcaagtgcgattctgtctcgtatttgcgagctatgtaggtaaaaaaattacaccaatgcctctataattgcctgtcttacttctgctatcatatctgtttcgctctctgccatcttcttgtaaaatgattctcctgtttctgcatatttttcagcaaaatagcttcttcttttctccatttctctgattctttcttctgctaccttgatatcattttctaatgttgccataatatatacctcccaaatgttttatttattgtttgattatgtatatattataactcgcacttgcgtatttgtcaatagttttgctctattatttcgagtttttctcgcacttgcgtttttcaattttcacatcatacccagcagcattgataatcctcacgaaattctcatatctcatattcccagaaatcaatctgctcactctctgtctggtgattcccattttctgagccagctggatctgcgtcattccttccttctccatcattttattgatgatctctgccgcatcttcgcctctgatctccgttacggtttcccttgccggataaactaccctgctcatttccaaactccttcctttttcaaaacctgttttaccgcctctttcatcgtatcagcagatgctacatttgtgtcctgattcttttcgtacaagctcgcaatcttgcagatgatatccggattgtcatttaagcctccggcaatacctttaggaatcccccaataatcgcagaactcttcaacagcattctttatatcctcttccagatattctctttccctgatccggtacgcttcttcgatttctgcctctgtcaactcgattttcactgttctctcatcacagatagaaatcccattaagttctgccactttgcttaatatagttctctcaattaccatgtcttcctccgtttaccagttcggtcactccttccggataattctcatcaaaccagtgccagatttctattctgtccgttccttccgaaaatcccaggaactcttccaaaatagcatcttcatcatcaatggggatttctccaaaaaactgccacagcttttcaacttcctggctgttgaagcggtcagaaaaatcaactgttgcaatgctatctacttccttgcaccgaggacaatattcctcatcatttccataatgcaggcccaggtcggagtcccttcctatccacccacacttcttacatctccagatcaacatttcccattgcctcccattcttctgtcagtgtcactgtctctctctttgcaaatactgcggtgcttaaatcaattccgtaaaaaatttcctggtttctcaccttctcctcgaagcgttttctacaaagcagctcgtttccgaatactcctccaagctgtacatatcttccatcgtcaatccgctttgccagcactgtgtactctgtgtctggagtatttacagtaataagtctgctctgttcttcatctcctacagtccattttatcttctggccacatttctcacagtagggcttcttcctctgatcgactgctcttttagccacaattcttctctctcccacaatgctgctgcagcaaggacaacggaaccaattatttacctgggtttttgcctcgccatgtccatccgcataatcaacgaatatcacacttctttcgttcatgcaaaggaccggcggcattgctactgatttttttaatgcttccaaaatttcctgattgttcacagttcttttcctcactttctgtacccaacgtataacaaaaacagtaacattagtatagctcccatactctcgcctcctacaaatatgatctgccatatcttttcatgaattgtgatctgactacatttccttctaccttcgccatctgtcccttgctgttgatagttaccgtattttttaacagccactctctttcccaggccagctgcccgatcatctttgacattctctctgccataggattttcgtgaatccggcacagcttctggcccatattatgacagttgttacataccggaactttcaatccgtctttctctgacagttctcttcctgctgttccgaaaatcaagtgatgttctgcttctgcccgccggccacaaatgaaacagatcgtttcatgctgtgtaacaattcctttgctcattttttctcctttctttagtcaaagataatttcatcaaacaaagtgtactggatgatttcgtccgccatcggtgcgtcaatctgactgcagtcaatcttgttctcgtataaacaagagctgctgtttcttgaacagttcagccactcctgtaatccgtgcagaaacttttcctgatccatttcgtaccattctgtttcttcattgtcgaacggttcttccacatgaaatttcagttttccgcctctgctgatttgatcgcttgcatattttccaaggtaatttccaacgactcttacgctgtcgcaccaataagtgattcctccttcaaatgcagtgcaaagaatatcgtctatatcctgttccgacacgttgacggatcttctcacaaacaacgtctcaacaattttcttttcttccatctcaatcctccaattctgtgccacataccgggcacttttcaatctcctcaccataggtctgaacatatcctacacaatgcgggcaccaagcaatttcgccatttgctttccagtcttccaacagactttctggatgctgccaatccagttcctcgaacattgtcttcgccagttcttcgtctccggcaagtattttcagtatgtcgttcctcgtatacttttcgtccgacaattccggaatatagcaaacatcgtctggcctgttctgaaaagcatcttcatccttgaaaatccatccttgccggtaataatctcggtcgattatctctggcttgccttcattttccggtgagtaacttccgatcagaagcactttcttactctgcatacctttattcctccgaatccgcataatatacgtcaaatgaaataccggctttaatcatcttgtccgacagataatttccgtagcaccagccatctccatcttcccagtagctgtcccatgcttcctgcagaaccttttcagccctttccgcatcttctgcacttacaataaaaatacagtccatccactcattcatttctgaataaacccggatacatctatcgttcagtaatccaaccatgtcacatccactcctctacaaatcgaagaaactccatgtcctcttcctggtatccttttcctttgagaaaaccttttgcctcgtcaacgctattaaatgtcattatttccgctccatcattgctcaacagccattccagcggattcagcgtgattccttccatgtgtcggcctactactattctctttttctttccagcccaacccatgatcttttcttctgcgaatctttcaatggtttcgtaatagtcctcgtcgatttcattccaattctttgagccgtgcaattcctcgaactcattcgcccatgcaacgaaaagatgcttccagctcatgctatctgtatttgttaagaaatcatactctaccttcaggctttcgtacttccaagcgatctcgattaaattctccgttgctctgttaaactctgccttctgaatattcaaatatgccattttactcctctctgcaattctgcatcgctttgtagatttcttttctcctgcgggatcttgctttcttttttaagtctcttctccatcttctgattgtctctgccttggtatgattccgtgaaaattcataatcatccaatacatatctgccattgtgttctctttctccgtaggctgacatttttctgtgtcccatattttgctcactctcctatgtaataacaggtgaagttccagtggtctccaaactcgtaataaattcctcttttttcaaaaattctatcaaattttttcttgattccaggattggtcccataccaaagcatatggcacacactgccttcaaaagccatactgaggatatggtcttctgccacattctcaaaatatcttcttgggtcctcgttttctctcacaaccagatgttccggatcattgtaatagaactcgcctgtctccttgtcgtgtgtgtcaaagcattttccgttgaaataaatctgagtgtccacccacatatcgtgttccaggagaaacgtccggatctccactgcaagtttttcaatctgcttctgtgtcagctttgctaccgtattcatgctgttgccacctttctcttttttctgagtaatctgattaaatgttcttttgctttctgatactgttcctctgatctttcatccgaataaaacatatccatttcgtaccaaccatcatacccatgttttacctcgaagccatcatccataatcattaccacacatccccatccgtgatttgatgtctcgaatgacacgtatgcgcttattttctcctgggctttcattgccagtcgaaacagctcttcgattttctttttcatcccgccacctttacctttctgctatgcaacgcatatatcatagttcctcgtccttttccggccactttggaaaattcctcatctgacatcggattcatatagaactgcactgctgtcaattcgtctgctgtattgtaaattttaaccgcataaagtacgtggtcggctccggttcttctcagtgtttccgctgcgctattctcaaaactcagaagaattttcggaagctgagagaggaacatctgccctctctgtacgcaaccattagtgtccttcatgctccaattaatcattttccccatggtctttagctttctccttttccgctttcttggttcttgttctctttgctgccggcttctcttctgtcgcattctctgtcttcggctttcttgctcttggctttttaaccggttcttctatcggttcctctactgctttctctgctggcttttctgcttcagctacctgctctggcaagcgctcctgcaatttgtaacgctttctgatggatgcgatcatcagctcaacttccgcatttaccagttccttctcttcatccgtcaggcctgtaaccaggtcttctgactcctgccagtatcctgcgttatccaggaaacgatcaattactttctttgctctgtcgtgtttaacatcccatttcatcctgtaattcctcctacttcttcaaattcaaaaacgcctatgctcttgataaatttcttcgatgtcttcatccctcttcctacctgctgaccgctgatatactgccggagataatagccaccaaccagttttacaacttcccataccttcttttcattccatcgatccctgtagtaagttcttcgcactgccaatgtttatgtcctcctgcttgcctatctcaatgtggcttccaaaagattatcaactactctgatatccacaacctctctgtccatcagttcatccatctcttcactttctaagaagtattctggaaaatgttctgtgcggaagctcgttccgtacagttttacaaccactctgatttttgtatcttgcgtagatgccattacaatgtcatttaacttcatttttcctccctcactctctcacagccactcttcaaatctttctggatcaaggctttccattctgtcaaataccaggtcgatcatcggatgaccacttggaagctgattgaacaattctatgcagccattaaaatccaatttctcgatcatatcttttgctttcttcatcagtgtttccatcttctttcctccatctcatctactgccaggccgatcactgctgtaccatttgccattaccaaccagaagtttaacggctccatcccggttgccattccccatgaaaaattgataaacagcaacactgtcaaaaatcttctcagctttttcattgctttctgtcctcctatatggtagacttgatagccaaggggagttaccgctcccctgctaccaaggaactgtttggttcgatttacttaatccaatttaagatcgccgtaacaactgctaagagcattgttactatggcaactacgatgctggtcaggctctcgtaaaactggattttaagaagtcgtttctcaagcagttctttttctttgtcttccggtttctttctttttgccaactggtgttctcctttcagattatttaatcaatctcgcatttgcgaaccatttgggtaaaaaaataacacccacctgtttggttcttgtgttttgtttgattatgtatatattataactcgcacttgcgtatttgtcaatagttttgctctatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattatgtatatattataactcgcacttgcgtatttgtcaatagttttgctctatttatgcaaattattttcgcaactgcaacattcaataactaatagtgagaataaaagaaaaagatagaaaaagatttagatacagaaatagatatagagtaatagtgacgtgacggtttcgtgacattgatgggacaatgtcacacgttttttattataatatgaagattttcctttatttataaggctttgcgcatttgtatcttatcctcaactgagtgtggataatgtggaaaactcgattttacgaacattggaattactggttgacttttttgtctgatacgcatatactgaaaacagctaagggtaatggcgattatccaatgagcaaaacgaaaaccccggagatggatcagatctctggggttttctattccgttatgtaggtggcttatgccttaggctgctatgctgcctatttgtcttttctgtccagccatttgcaaatgtagtagctaattacatttactgcgacagggacaagaataatggcgattattttatccaatgatttcacctcctttctgctggaggttcggcagctctttaagaatatcatatttttcacaaattatctaccggaaccacaagcatttccccgaaaaaagcatatagggctatacgctcgtacacgcccctataccgaatttttgcctttaggtatattaggtattgaaaaaatctctatcgttgctcaggcacatttcgtcaaaaatagcattgaaattttagttattttgtatattgatttttacctctaacttgttccgcattttgcaataaaaaatgccccagtcccgaaggaccagggcgtgtgtgatatatttttctcagaggtgcagactctcttcaaaagcaccatttctccgctgttatttcagtagcttgtttacttctttctggacttcggcataattgtaaccggctgcttccagttttttcttccgatcggctccgttcccccattttccggaaacgacttcctttgcaacttcagctacggatttctttgttcttgtcttcagcagctcattcaccttcttctgaacagtgtcataattatagccggccgcagtcagcttctttttccgctcatctccgctaccccatttaccggcaatcacctctttggctactgtcgttacgtctttcttgttggatgtggtggttccaacctttttgttgtacagagcggtcagcttggctttggaattagttccatactgtccatcaaccgtcagcccattgtctttctgaaatttgcgaagagctgaatcagtgtcagagccgaaatctccgtcagctcctgcggctccgcaagaatatccaactttgataagcattttctgcatcgcggttacttctgatccggtatctcccttttccaaataattcttctttgccggagttgcattggaactggcatctccactcactgcgatagccacatgatgattgtcattcagcaggatatctccaggctttaagcatacaaatacgctgtcagatgccatctttgagatgccaaacacgccagctacatacccatcaatcagcaatgccctgttgaatgtggccgatgaaccaacaaaattatgtgtccacaactctctgtaatactgagcctctgccgccttgaccggaataacctgcactttgctgtcttccttgatctcgtagtcccttggaagcatactgcagtctagcggctgtagcttactctctgccggccgtttaatcttcttaccatttgccagggctgttgcctcttcctctcggttcgtggttatgtaggcgttcaggtctgcccttgtgccagatcgggcatatatcgtataaccaactgcctctcctactcttttctcctggtagcaaatgaccaatgcttttgcgttcatacagagatcatagaactgctggtgcccggtctccgggtcaaacagttcatacggtggttccttccaggtcatcttgccctgcgtatcatagaacttctcatagcccgaaaaataggtcggtggatttgcaatcaccaaagcgtgcggatcgtccagcacctctttcagatgttcccacatatccagtggtctgtagctcatgccaccaagcagattccgaatgacttctatctgccggttgatgctctctatgtgttcttctctcctaagccgtaggtccgtgagtatctggtagaaataatcattccctgcgttcttcgatgttctgagatacaactgtgcgtacaacgctgttgcaggatcaagaagctcctcatcgctgaatccttgtgcatggatttccagtggctctaatgactgcccggttatcgcatacccaaggactgttgacatcatattgacatcgctggtttcaatctgctccggcttgaatccattctgcactgccagatttgccattgcgaaggtgccggcacatggctcaacaaatctcgtgtacccggactttgctgccgtttctatcagagtgaccagaaacttctgctccgatggacctaaacaccccaagaacattgcccctgggtccataaaaaacgccattgctttcttctcctttctttccgtttttctaaaactgtactatactgtctttacaggctcatacgagccgagtaataaaccggaggtgaattatattgtcgagacggatttctctcatacaccatgattactgcccttacctggaagaacggcatggtgttcgtgttgattacgccgagttttctatgctcggtgccgcagctcctggctataagatattgggctattcctgtgactgttcggatgattgcccttatcctcgccgagatgtgcgtggggcttgtcctgtattcaacactgcgccggaagaaccattctgatcttcaccattgaatctttcaacagcggtgccatgttcgagagccagtcaaaattgcactccttattcatcgggcagttctggcatggctctccgaaatccgcttttgcatcacccgcagcctgttttctgaatgtctcaatgtgttgtgctatgcaggtagctgatacaacgcctctctccattctaatttccctccttttttgttcactttatacaaaaagccagatcaatctctgataccacgccgggattttcagagactgttctggcaaattgcacaaattaaggcaccgtacccgaagatacgatgccgtttcttttggaccggaaccctgcaatgaacaggaactttcctctggaagagaaatgtgattctttcaccagttccggatattatatcatcgcaccagccataccaaacaaactcatctgttcatagccttccgtttccgtcttggcttccttctgagcggctgtgcgcttgctttcttctttctttgcctgcttctgtacaggcggtttctttacttttggcggatttgggtccggcagttccttgatgatttctcctgtctgttcgcaataccactgagcgaatactgttctgtggcaccagtcttccggtattcttacatcctcgtaacacaggaaaaccaattctttgcctttggccgccgccattgcctcgaatcgcattaccatgttgataatcttgtcattgccaatgccttccagcttccggtaatactcctcggtgaacttctccagttccattctcagcatatatcctttcggtgccagcgaatagcactgctgttctacggtgtatcccagtggaaatttcggcgttcccaaactgattccgacacaataatacttgtctttgttctctaccagctctttattgctgtatctgcttgtccaaattgccatagctttgtcactcctttattctcgctaatgcgtattatctacaatttaattatactatgcgagctgatctaagtacactttattacccttttttaaccgatttttcataattctggagttttgagtgggcggcatttctgcctacccactctgccttcacagaagaaaaacaatgccttttttaggggtgacacatagcttatcgggcttttatcagaataccactttgcccttcgcttgtctagtgcgcctttttcgcatttgcgagatttctcgtatctgcatttcgcatagtcttcttaccggatttctttggtttccggttcacctctatactttttactccttctatcccaaagaataaaactgccagatcatcgtatgccttttccaacgtgcggtacactgtacttttatcaatctgctcctcttcggccacatcttctgcccgcaccggctccgcctgcaggaacattctttccactacccggtatctccgctgaatatcctggatctttgactttctacattccttcttgtaattctccagctgcacatctacatggttcagaagcattccggtcactatccggttcttattcgtgctggtaagattaaattcctctttccttacctgctccaggattccgtccaggatttcttttagcgtaggatctgtcaccgtgtctgtccctgttaccgatgtattcttcattttctttagctgccggtaatgaatgatgatcgttttggcactgttctttaccttatctgccagttcctctttgtctttctcttttcttctctcgtaggcttctactcctttcttggctccctcccggcctgcggcctttatgagcctttccaattcttcttcagtcagggaaatgtatttcactccctgtgcttcaccctcagccttcggcgtattttcttttacattttcttctacagccatgctgccacctccttgactttttccatctttccgggttataattccggtatcgtgtgtggtcgtctttcgtcagggaggcggccttttcttttatgtcaggatctgcagtcccaaggcaacataaccttctgccaaccctatgaacttatcatccaaaatatatctgaccatcgcaccgacttctcttccagtatatttgatgttgtcccactctttcagaagcagcacatctccaacctggaaattgcgatcattcttccggatttcaaatggcttattgccttcgattgtttcctggaaatattttggatatgtcttcagctcatgtaacatcctctacctcctgtaaccagggcaggtcgcaaaatgagaaatgtaaccgtagccatccgcttctttcgccttgcatctttctccggccacaacttctccattaggaagtaccaatctttccttaccgcccttaatcttcttgaaatctacaaactggggatctaccggcatattctttcctgcctttgttttcacccacataattcttgccccgcatctattgcattggctgaattgtcctgcactatcctgcttcattcttttttcttcctccttggacaccatcttgggcttgtcttcaccgtcagcttcgtttcgtattctggtgtgccgaatcctataaaactcggcatctgatttccaaaagcttctctcggcaacctctttgtttcttgattttcgcagaagaaatatcctcttccgtatccatatccgccagtaaacttgctctctgcccgattgcgcaactcgcaatgttggcactccttgcatctcggtatcattacgcacctccttcgtagcctaattctattgccttcagttcctcaaagctcacatatctcaatgtcggaagcaggatcgaaggttctcccagcaccactttctttccttggatgctccatttaggataattcacactcacattgcattttctggcaattctgaatatgccgcaattcctataagctccgatgctctttctctgctttccagccttgcatcccattctgccgcctgttttctggctctaaaatacggattctggttttcttttatagggttccgtcccattctcatttaccttactttcacttataatttaatcagtgcctacaggaacggccggtacttccacttttaactgttcattgatcttctcgatcactggccaatcaagtgcatggccgttcagcaccaacgataccttgtctcgattgaatccgatggacttgctcagctcgctgatgttcattttttttacatacagttttgctcgcactgctccacaccattcatcggacggaagctgcggcttttccggaagcacgttcacttccagaacttcgttaattttctttgcgatatccaggtaattatcctttacgatccggccgctgataagggctgttatcgttgtatagctgtagccgatttcatcagctacactctgaaggttcatttccttcctcgcaagcgcaactcttatttccttgcaccattcagaaatggggacagtagtattgctcatttgcatcgatctcctttcttgcatctgcgattcgcatttgcattttttccgagtgcgtgctataatacaaatacgagttattacgaacacgcaatcaccatgaaacagattttaaatcataggctcgcaaccacgaataataatttgtttcatggttatattatagcacgaatctgcgtatttgtaaagattttacctcgtatttgcgtatatttttacacttggaggtgtctaatggaaatcattgaacgcatatccgatttactcgcagagcgtgataaaacggccatagaattgtgcaaggttctcgatatccaaacatctactatgtctacatggaaaaccaggaagaaagatcctccggctcgctatatgccggccattgcaaattttctttgcgtttcgctggattatctcctgaccggtcaagagcgtcctgctgtcatagaacagccagaggttcaagagccgaagctttccgcaatggacgaagaacttttggatttattccatgaacttcccatgagcaaacaatatgaatttatgggagaaattaagggcttcttgcgtgctgtcgaggactcaaagaaatacgttgacgaagggaaaagattatccggctgagctggtatcgcaaaactcggtactgacaggaggatgctttatgcaacacaacgcaaccaagtatttcgcacttgcaagaacagaagagatggccgggcatgacgcaccggccattcttttttaccttgcttcattctgcgcaagtcttaattgctatgatacccaaactttgtacaggacaaccgccaaaattcaaaggttacaggctcgtatctctttacctgatgaatccctaattgtcatggttcactcttacggtcctctctcggatgaagtgtgtcaactctctctgcttcaatctctgagtggagagttgccggctgtccttacctaatgaggaggaaacaatggaactactaaacggaaatgagaaatttactctcgatggaaatgatactggaatatctgtctctgaattttggagctgggcctattctgatctgcttaacaatacgcttcgaggggtgttggcagaatttctcgtaaaaaaatcattctcatttttacccccccccgagaaattttgaggactgactggacaccttatgatctaaccagcccttccgggcgaaggattgaagtaaaatctgccgcttaccttcaatcttggaccgaggactacttttcacacattatttttgacatcgcaccaaagcgagcatggaatccgcagacaggttattctcctgagcggagccgccattctgacctgtatgtcttttgcctgtatactgccagaagtcgcgagcaatccataagaaatcttgatctctgggaattttatgtattgcctacttctgttctggatcagcaaaaacctaaccagaaaagtatagctttaagctctctcctttctctggagccgataagaacaaatttccagaatctcggaagcattatcgaaaccatttcattgtgacaggagatgatctattgaaattaccgaacggttatggaagcgtaactaaattatccggaaaccggcgtaagccatatctggccagagtaaccctcggctgggtcataaatgaagaaaccggaaaagcagtacagaacagagttcctatcggaacctttaagactaaaaaagatgctctgcaggctttagctgagtacggagctaatccctacgacattcagaacgataacatgaccttggccgagctttacgaaagatggacggcagcttactttcctaccctcgaaagtgattcttcttccaggacaatcattgctgcctggagatattgccacgccatacaggggatgcgtgtaaaggatctgcgtgctcgacacataaaaggaatcatggaagacggatatgtaattcaaaaccggggcaaggacgccggggctaaggtgcctgcatctccgggaacgaaatccagaataaaatccatgttcaacctaatgctggactatgccatggaatatgatcttgtctcgaaaaactatgctcgtacctttgagctttcaaatgacatcatcaaagaaaaggaagatgcaaagcgtggccatattaacttcaatgattctgagatggaagccctttggaatactgttggcaacattaaattcgccgactggttgcttatacagtgttatatgggatggcgtccccaagaaatggggctcttggaattaaaagacgttgacttggaaaagtggtgtattaccggcggtatgaagaccgaggctggcaagcaccgtaccgtcccgatccacactcgtattcgggacctggtaaaaagaaattatgacgaagcagtttctcttggaagtgaccgcctctttaatgatccggaggctgccaagggcggtatgagaataacctatgacaaatacgctgggcgctttaacaaggtcgttgccgcactgcaccttcgttccgaacatcggccgcatgatccccgaacaacattcattacgatggcgaaaaaggcgggcgtagatgagtacgttgtgaaacgtcttgccggtcacaagatcacagacgtaaccgaggcggtctatacaatccgtgatattgaatggctcagagccgagatagaaaaaatgccgtaacccttgtggttgcggcttttcttttcctgtgaacggttcttctttttgtttccttcgctctgttgcctacttgttgcctacctgttgcctatcttgccattttcaaggcttctcaccgtgtctcaaattactttctcatttttttgatctaaactaagaaaagtaccgcagcccttggaactacggtactttctaggtttgttgactctttgattaaaaaggtttgattagaactttcctgcgtctgcagcttcctgtacggctacagctacagcaactgtcataccaaccatcgggttgttaccagcgccgatcagacccatcatttctacgtgagccggtacggaagaagatcctgcgaactgagcgtcagaatgcatacgtccaagtgtatctgtcataccgtaggaagcaggacctgctgccatgttgtccggatgaagtgtacgtcctgtaccaccaccggatgcaacggagaagtatttctttcctttttcgttgcattctttcttgtaagtacctgcaaccggatgctggaaacgtgtcgggttagtggagttacctgtgatagaaacgtcaacgccttctttccacatgatagcaacaccttccggaacgctgttagcgccgtagcagttaacttttgcacgaagtccttcagaataagatttacggaatacttctttaacttcgttcttgtatggatcatactctgtctccacatatgtaaatccgttgatacgggagatgatctgagcagcatcttttccaagaccgttcaggataacacgaagaggttttttacgaactttgtttgctttttcagcaataccgatagcaccctcagctgctgcgaaggactcatgtccagccaggaagcagaagcagtctgtttcttcttccagaagcattttaccaaggttaccatgtccaagacctactttacgtgtatcagcaacggagccaggaatacagaaagcctgaagtccttcaccgatagctgctgctgcgtcagctgctcttctgcagtcttttttgattgcgatagctgcacctacgatgtatgcccagcaagcgttctcgaagcagatcggctgaatgcctttgatctgatcgtatacgttaaggcctgcatctttagtgattttctctgcttcttcgatagaagcgattccatagctgtttaaaactgaattgattttgtcaattcgtctctcatatgattcaaataaagccatttacttatcctcctgaaattataatcggtataattattctttacgtgggtcgatgatcttaacagcatctgcaacacggccgtactgaccttttgctttttcccatgctgtgttcgggtcatcaccttttttgatgaagtcagtcattttgccaaggcttacgaactgataaccgataatttcattatcttcgtcaagagcgatacctgtaacatagccttctgccatttccaggtaacgaggaccttttttaagtgttccgtacattgtaccaacctgagaacgaagtcctttaccaaggtcttccagaccagcacctactgcaagtccgtcttcagagaatgcagactgggaacgtccgtatacgatctgaaggaaaagttctctcatagctgtgttgatagcgtcacaaacaaggtctgtattcagagcttccataactgtaagtcctggaagaatttcagatgccatagctgcggaatgagtcataccggagcaaccaattgtctcaaccagtgcttcctggatgataccttcttttacgttcagggacagcttacaggcaccctgctgaggagcacaccagcctacaccatgtgtgaaaccggaaatgtccttcacttccttagcctgaacccattttgcttcttccgggattggagcggcgccgtgatggacaccctgtgcaactgggcacatttcttctacttcgcgtgaataaatcatgttaaaactcctttcaagtatagatttacttatgatgttgttaaaagatagactaacaacctgaatgtattttctcacaaagcactcctgttagtccagtcaaacttatgtcaaaaaatacgaacttttgtatatagatatcatataattgccgttcttgtataaatgtgataaaattcattaaaaaacaaggagaaaattctatgtctgacaaactccctccaagcatttttccggcacgctttcagattctaagtggcagcatgctgaaactgcttgcctgtattgccatgctgatcgatcatacaggtgcaatcatactcagccactatccgccggcgctcacggagctcttttatatcaatggaaaaggaattactttctatcgtattgtccgcgatatcggacgatgtgcttttcctattttctgtttcctgatcgtcgaaggattccttcatacgcatgaccgcagaaaatatggccggaatctgctgctgtttgcgctaatttccgaaattccgtggaattttatgtttgcaaacacctggcattatgctgataaacagaatgttttttttactctctttcttggatatcttgccttctgtgctcttgaatacttctgggaaacaccgtggatgcagcttttctctctgcttgctctcctcggtatctctatcctgctgcatgcagattacggatggcgtggtttcatctttctcgttctgatgtatcttctccgaaatgagaaagtatcccaggcgatcgttggaagctgctggctgagttatgaatggaaagcctgttttgcctttatttccattaatatgtacaatggaaaacgcggctttatccgaggaaaagccgcgaagtatttcttttatttattctatcccgtacatatcacaatccttgtgatcatccggaatctcttttttctttaaagactgttttggccggccttaattctttttgatgatctcggctgcgtttttgtagatactgtctgccggaatgcagcctcttaccggtgaaagcggatatatattcgtatttctgccgatcacagttccagggttcagcacagagccacatccaacttctacatggtcaccaagcatggcaccaaatttcttcagtcctgtctctatcttctcatcaccatctttgacaacgaccagtttcttgtctgatttaacgttggagcagatagaacctgcgcccatgtgggatttgtatccaaggacagcatctcctacatagttataatgcggaacctgtactttattaaaaaggactgcatttttgagttctgtggaatttccgacaactgctccttctcccacaattacatttccacggataaatgcacaatggcgaacttccgcatccttaccgataatagccggcccattgatataagcagttggagctattttggcagattttgcgatccatacattgccatccttacactcatactcagacggattgagtgtcggaccaagtttcataataaaatcactgatttccgggagaacttcccacggatatgtctttccttcaaacaactctgcagctattgtttcattcaaatccagaagatttgcaactgtaaaatcttttaacatgattatgattttcctcctcgtctggaagccattggcttcgatttataattcgcagcggctgcatcaaaaaactgccgcagtgcatactgataattactctgttccacctgagcggtacgcacacgcacaaaatgttccagtttgtccatgtactcctgtgaagtaatacttccctctgccacatatgtaaggcccttttcccagcttgctgtcagttcaggattcagaagctgacgaatcgaacagtttacaacatcaaatatcatctctccaagaagcgttggtgtgattacctgtgtctttttatttaacgacaagtatttgatagaaacaagtttcttaagaatctctgcccttgttgcactggttccgattccgcttcccttgatctgtgctctcagttcctcatcttcgatcagctgccctgcattttccattgccagaatcatagaacctgaattataccgtttcggcggagacgtttctccctctttaatgttcagagcatctacggtcagtatatcattctttttcagtcgctgcaacgcattcaaaagctgcacgtcacaggatgcctcctcactgtcttctttgccggactcctgtgatctgtctgctgctgattttctggcaaaagaattcgtcgcatatttcaggtatccttcttcctgcagcaccttgaaaccggaaaagaacttttctttctgcatctctgtcaccagactgactttctgataaactgccggcggacagaaaatacagaggaaacgtcgtacgatcgtctcataaactctctgggatgtctgagaaagacttttcagaacatttaatccctgacctgtcgggatgatcgcataatgatctgtaatctgtttatcattgacatatctggtttttgcgattgttttgtaagaacccatctgtaaaatctcatctgctgcattgtcgatcatcagatatcgacgcagtcctgaaatatttttataaatttcttttgcaaccgcactcgacagcactctggcatcagttctgggataagtcaccagttttttctcatacaattcctgtgtaatacgaagtgtctcgtccggactgatcttgaacagtttggagcagacattctgaagctctgccaggttaaataaaagtggcggatttttgttttcttttttgcgttccaccttttctacgcggcaggacaagggttgttccgactccaacatccgaatcagttcctcggcatgtttcttttctttgaagccattctccttataaaggtacggcgactggaaatatctgcttccttctactgctctccattctccatcaaagtgttctccttccagtgcaatactggaaaggacacggtaaaacggggttttcacaaaagatcgaatctcccgttcgcgacgcacaaccattccaagcacacatgtcatgactctgcctacggagattgcctgatatttactgttcaggtaattagaaacattgttgccataacgcaaagtcaggactctggaaaaattgattcccatcagataatcttccttcgcccgcaaataagcagaatctgccagattgtcatagactgacagttcttttgcctcgcggattcctctaaggatttcttcctctgtctgggaatcgatccatactctacgctgctctttatctttcacacccgccatctgtgccaccagacgatagatatattctccctcacgcccggagtcggtacacacataaatcgtctctacatccggacggttcagaagccccttaacaatgttaaactgtttctgcacccccggaatcacttcatacttaaattcacgcggtaaaaaaggcagggtatccaaactccaccttttatacttgatatcatatttttcaggatagctcatagtgaccaggtgcccaacacaccaggtcactacagaatcttctgattccagatagccatcctttctctgtccgttaatttttaatgctttcgcaaattcctgagcaacacttggtttctcagctatgtataaggatttacccatattatttatctgcactcatctttctgagaggccatgcaagaagaagcgcaccgcctgccatatttcccaaagtgacgattatcatgctcttaaccattgctccaatggaaactcccggtaccagacatcctgctgttacaaagatacccatatttgccacacagtgctcaaatccgctgacaacaaatccagaaatacacataacgatcatcaaaaactttgcaacttcgctcttaagcttaatgccacaaagaaccccaagacatacaaagaagttacacaaaactgcacggaaaaacatctgacctgccggaattgcaagtttatttccgataaatccggcaaaataatctgctgttccggatgctcccgcccatacaaaaatcagagaaagaatcagacagccaacaaagttaccgatatagctgactacccatactttagccgcatcgccccagctgatcttcttgtcaaatgctccaaatgccatcaccagattatttccggtaaaaagctcgccgcctaccagcgaaatcagcaataccgcaatcgagaacacgagtgcccccaggaatttcccccatgccggttcttcggcccctgagaacacatttcccacaacattagaaaagatcattgcaactacaataaagaaccctgccatgatcgcccgcatgaaatacttgaaaaagtcatttttcagcagggtaatcttcgcgtttgctgcatttgatagtttctgtacatcctcttgattcataaaaaatacctccctttccaaggaacagagtatcttataaactcttttgttccctccacatattgtattcttgcattatagcatttttgatataaattctcaatatatataccgcaaagtttgatatttttataacaaattttcatttattttcgataactgtcagttatcgaatctccagtgcatgattttcccggtcagtcacttcaccgatcatcgcacaggaaagagcagattcactcaattccagaagtatctcttctgcttcatctgccggaaccgccgcaagaagtccgccagacgtctgtggatcaaagaccagatcctcccgccagagttctgctgtgcttatgtaaccggattttgctgcaaattcccggttgcgatatgcacctcccggaatcaggcccatagaggcatattcttctacatccggaagaatcggaagtgcttttgcatcgatcacaagtgtcttcttactaccgtctgccatttccgttccatgtccgccaagaccaaaccctgtcacatctgtacaggcatgaacagtatgtctttttaatacgtcacgggcatatctgtttagcgtcttcatagatttcaaagctgcttcccacgcctcttcagataccatatcggctttgatagccgtattcacaatacccgttccaagcggttttgtaaggatcagcctgtcacctgtctgagctccgtaattcttccagaacttctctggatgtacaaagcctgttacgctcaggccatacttcggtgtatcatcctggatcgtatgcccaccggcaagtacagctcccgcttccattactttgtccgctccgcccttcagaatctcaccaaggattgctgtatccatatccttcgggaaagcaacaatattcaatgcggttttcggctcaccacccatagcatagacgtcactcaatgcattcgccgctgctatctgcccaaaatcatatggatcgtctgcaaccggcgtaaaaaaatcaagggtctgaatcattgccagttcgtccgaaattctgtaaacagctgcatcatcagatgtttctgttccaacaagaagattcggatcctgaaatttcggcagtccacaaagtacacctgccagcgttcccggacctactttcgctgcacatccacagttgggggcgagctttgtaagatataccttctccattttgctcaatttcctttctgtcttaaccttgtccatctatgataacataaatcttccgttttctccatgtctttttttgacagaaaagcgcaaaaaaactgccctggcagactttatttcctgtcaggacagttctggttaaatatcattatttgaaatgatttttatttctttgtaatatagccttttgctttcagagtttctgcgcagagtacagcaccaccggcagctcctcttacggtattatgagaaagtcctacaaacttataatcataaacagtgtcttcacggagacgtccaacagatacgcccattccgtgttcgtagttgacatcctcgcttacctgcggacggttgtcttcttccagatactggatgaactgtttcggtgcactcggaagttccagttcctgaggaagacctttgaagtttctcaaagcttcgatcaactgttcttttgtaggttttttacggaatttaacaaatactgctgctgtatgtccgttcagtaccggaacacgcaggcactggcatgtgatgactggttctgttgccggtacgatcactccgtcttcaatcttaccccacagtctcaacggctctttctcgctcttttcttcttctccaccgatatatggaatgatattgtgttccatttccggccagtctttaaatgtctttcctgctccggaaattgcctgatatgtagtagcaactacttcatatggttcaaattctttccaggcagtaagtaccggtgcatagctctgaatggagcagtttggtttaacagcgatgaatcccttagtagtaccaaggcgtttcttctgatactggatcacatcaaaatgttccgggttgatttccggcactaccatcggcacatccggtgtccagcgatgtgcactgttgttggaaacaacaggagtctctgtctttgcgtattcttcttcgatcgctttgatctcatctttggacatgtcaactgcggaaaacacaaagtcaacagtagaagcaactttttctacttcattaacattcataactacgatattctttactgcttccggcattggagtatccattttccatctgccgccaacagcttcctcatatgtctttccagcgcttctcgggcttgctgccagagtaacgacctcaaaccacggatggttttccagaagagaaataaatctctgtcctaccatacctgtagcacctaaaataccgactctcagtttttcactcataacaatcgttctcctcactcgtttatttcacatgtgtctttgtacggcacacatctgttttctttgtacatactataccactttaatcaaaaatgcaagtggtttttaattatttttcagatattctttgttccctgcaatgatctgctccatcactttcggtcccggagcgccatatgtctcacgtttttccacacatgtcttcatgctgatcgcctcataaatatcctgttcaaatacaggtgaaatttctttgtactcttcaagcggaagttcatcaagagagattcccttatcaatacaagtcagtaccaggcggcctacaataccatgtgcatcacggaacggaactccgtgatttaccagatagtctgcagcatctgtagcattggtaaatccattctttgcactcgcttccattacgtctttgcggaattccatggtagaaaccataccggtaaataatgcgatgcagcccttcacggtatcaatagcatcaaaggtaagttctttgtcttcctgcatgtctttgttatatgcaagcggaattcccttcatcgttgtaagaatagaagtcaatgcaccatagacacgtcccgtcttacctcttacaagttctgcaatatccggattctttttctgcggcataatactgcttccggtgctgtatgcgtcatcaatctccacaaaacggtattcattggaattccagagaatgatttcctcgcagaaacggctcagatgcatcataactgtggacatggcagaaagaagttcgatcacataatctctgtcagatacggaatccatactgtttctggtcggtccgtcaaagcccagcagctctgcagtataaaatctgtccagcggataagtggttcctgcaagcgcacctgctccaagcggacaggtattcatacgtttacgaatatcagccatacggcttctgtccctgcggaacatctcaaaatatgcccctacatgatgtgccagtgtaaccggctgtgctttctgcaaatgcgtaaatccaggcatatatgtgtgcacattattctccatgatcacctgaagagcttccagaagtttcttcagttctgcatcgatctcttcgatctcatcacgcacatacaatttcatatcaagagcgacctggtcattacgacttcttcctgtatgaagcttcttacccggatctccgatacggtcaatcagatttgcctctacaaaactgtgaatatcttcatattcagatgtaatctccagttttccggattctacatctgcaagaatactgtccagaccgccaaggatctgatctctttcttcttctgtcaggatgccctgcttggccagcattctgacatgagctttacttccgcggatatcctgtttataaaatttctggtcaaatgaaatagatgcattaaagttgtatacaagtttgtccgtttcctttgtgaaacgtcctccccataactgtgccataatgtcctccttattgtacggtgattttgccactgccagatctcaccagaatcccacagtgcataattttctatcagtttaccacattccagtggaaaatcaaagagcagaactctctgaaatttgtttttatttcagtttttgtttcagtttttcttcctgttcgcgcttcgaaaagacgcagccacagtaattctgccggtaaagatcaaactcgtgagataattcaatcgaacgcttgtagccgtttttcttcttgaaatcagatggaagatgaggtactttgtaaatttctgccagttcttcgccaatctcgttgatcttctctgcatttttcagaggactgattgaaagcgtcgttgtaaaataatcatagtttccctctctggcaagttttgctgcttcttccattcggaggcggtagcatttgaagcaacgttcgccaccctccggaactttttccatacctttcgccatttcataaaatacctgcggatcataggtgccttcttcgatatgaaccggatgtgtaaaagacatttccgctaccagacggcgaatctctgcgactcgcttacggtattcttcctccaatgagatattgggattataaaaaaatactgtaatctcaaaatactgagataaatattccagcacataactgctgcacggtgcacagcagctgtgaagaaaaagccgtggaacttttccctcttttgttatgttttcaatgagccggtcaagctctttctgataatttcgtttattcatggtgatattcctcttgtaagattattgctgaaatttctatatggatctttctgtgtcagactgtttccgtgatcctttttcctatcataacacagatgcactctcccgcatatcttaaaatatagattctctttcgaggtattttgtatgaaaccccttctggagatcagaaatgtttctctttcttaccataccgtatccggagagacgaaagctctttcaaatatatcgtttgacctgatgcccggtgaatttcttgccgttgtcggtccatccggctgcggaaagtccacgctcctgaatctgatctgcggcatgctcccggcagaagaaggcacgattcttatgaacggcatccctccgtctcccggcgatccacgcattggatatatgctccagaaagaccatcttctggaatggagaagcatctaccggaatatcctcctcggtcttgagatccgtaaggaaaaaacgcctgaaaaacttgcatacatcgaaaaaatgcttgacacctacgggcttgacaagttccgcaccgcccgtccttcgcagttatccggcggcatgcgccagcgtgcggctcttatccgcacactttccctgaaaccggaacttttgctgcttgacgagcctttttccgcgctggattaccagacacggttaaatgtcagtgacgacatcggtcgcatcctcaaaaaagaacagaaaaccgcaatccttgttacgcacgatatttccgaagcgatcagcatggcagaccgtgtgatcatcctttctgcccgtcctgcctatgtcgcgcgtattgtcccgatccgactgtcactggatgaaaggacccctcttgccgcacgcggtgcaccggaatttaagtcttatttcaatcttatctggaaggagctgaaccagtatgcctgacctttctcctgcacaaaaaaaatatctggcctgtgtccggcgtgaaaaatatctgatccatgtgtccaggatctttctgttcctgggctttctccttttgtgggaagtatctgccagacagggatggatcgattcttttatcttcagcagtccgtctgagatctggcgaacattttttaagatggtacaggatcagtctctgtttacacatatcgggatcacgctgatggaaactctggtcagctttgtctttaccgtttttctcgggatcggcacggcggttcttctatggtgctgtccaaagctttcacggatcctggagccttacctcgtcgtcctgaacagtctgccaaaatccgcccttgccccgctcctgatcgtgtggttcggtgcaaatatccggacgatcatcgttgccggaatgtctgtggcaatctttggctcagtcatcaatctctacaccggcttccgcgaagctgacccggaaaaactgaaactcatccgcaccctcggcggcacacaaaaagacgaactgacaaagattgtccttccgtcttccgtgcctctcatcctgagtgtgatgaaagtcaatattggattgtgcctggtcggcgtgatcatcggtgaattcattggtgcaaggcaggggcttggatatctgatcatctacggttcccagacctttaactgtgcaggcatacggatacgaactgatatcgtaatactcattttttgcctattttccggctattccagaatttcccagcagcccttgccaccggcaccattaaaacgaattcgcccttctttttttaatacttttaatttataattcgctccagacaaactacagcctatttcttttgcaatcatttttcctgtaatacgtggattctcgcgaataagatcaacaacaacttcgcgtgcgtcacactgtctgcctttataatctaatctgtttccataatcaactctgaaacatttcttatcgccgtcaaagattttaagatccatgcaacctgttacactcgacagactgaaatatatttccatatatcgcggatacaccacaatcttgtcaacttcttccagcatatcatcaatcgttgcctttttaaacagatcatcgtcatttagcctggtttctatttcctgcaggcggtcttttatgttctgcgtattggaagttcgctcagttaactctaatattttctttttgttttgatctcgcttcttttccagctcttcctgttttgtcttatacatctgatctgtcagcacaccgtcaatcagcttatcgacaagaaatttcatttttctctcgatgtcttcctgctctcgctccagcttctcaatttcttttgtgccgtcctgattattcagcgactttgaaagcagtttcattattttttcaatgatctttttcttattcttctgatattgattgctgcagatttcttctaaaacagcgtaaaactcattttccgcaatattaatgttgtcgcatcccttttcgttttccaagaacacttttcgcagatttggccgagcgcgcaaattatcggatctgccgagttccaaataggagctacaagcccaggtatatatcagctcgtgattgctgtgttttcggtgcactttcctccaataaggctggccgcacataccacatactattttaccgctcagctgatattttccgggatttttaccgatatcgtcttcgccgtcttttgttttcacagaacgtttatcaatctgctcatttgctgcattccagagctcgtcagataccgttctcggcactttatcttcatggatatatattttctctttaggatttttaattgttcgcttgctgtcaaaatcaaagtgatatttacccatgactgcagtacccttattaatcgggtttctgagcatccttaatatataactggatgtgaatggctttccatcgcgattaacaattcctctatttcgcatgatcgtagatatcgtacgtgttccgtaacctgccgcacacaacctgtacatttcacgcttaatttctgcctctttctctactaatgctacacttttatctggcatacgtttgaaaccgtatgcatttccagggagcatgacgttcccaccatccctctggcgatttcggtgagcattgttgatctttttgctgagttctcggctatattcttccgctaaaattgccttaatacccgtgataagagcatcatctgtactgtaaaatttgttttctatgtacatataaagttttttctgctctgtacacagacggtctacaaacaggtaccagtctttagtatttcgcatcagacgatcctgtgatttgattacgattacgtcaaatttgtctgtcaggagatcattaaataatctcttgtattcattgcggccttttgcggtagttccggaccgactttccacgtatcgatctacaagaacccagccgtattgtcttacactagactcagcttctgcaacttgtttttcaagggcgtttttctggctttcttcttctgtactacaccggcaatagataacagctcgtatcatatattgccttccttctttaccaatatgtacagtttacttttttcttcagttgttattaatttctcctgcagtaataattctgctaattttaatataattctgttctcattttcgaccataagattattcctcttacatactgctcaataattagcatattcagtcaatcaactttccgtctcttaacagaggaataatctttatgtttccatgttcatttcctctattaatcactattaatatgttatttctggtgaaaaatagcaaaaattcgcatgtttatagtcgttattttatcttttctattctttttatttaatttcctcctttttccttttatttactattaaaacaatacttcaatctatttcagcttctaggatttatgctataatgtttatagaataaatttacaggagggaaaatagattgaattattgtgtagtactaaaatattcacaagatgataaatgttatataatatctgttccggatctgcctggatgcatggcggacggtgagagtccgaatgaggcttacgaaaatgctaaaattgtgatccgtgaatggatagaaacagctcaggcagctggtaggacaattccggaaccatcttttggacaggataatttttaagggacagctttttgacaggctgcccctttttctgtgtttcttcttattaaaaaaagatgaaatctataatacgatgtagcagggattgattttgctgtgtttttacctgctgctggaattcgtcctgttgctgtcgcatactgtcgaactgttgctgttggaattgatcctgttgctgctggaatagttcttgttgcatagcatcttgctgataatacaggtcattcatgccactgttaaaatcgtcaaatccaccgttaaatccgaaatcgtcaaacattcttatatacctccacgttattaatacctgtaggttccggaatccggataccttctctgattgctgcagttatccaggcctgtttcgcgtctgctatcattgccggaatatcttgccacctctggcagcaggtaatgcatccgggtagatctggaatagttgcggtatagccaccctcaactggatcttctatgatttgaatgggatattttaatttcataaaataatctatatctctcatacctgcagtcctccatttttgtactggtgggccagcctgtaaaatgtagtcctgctcagtccagtcagtcccatcgctgccgctgcggtaatctctcctcgcgtccagcgttgcataacctcttcgtaattagtcggtaactgtacctgcggtctgccatagttattccaggctggtttatcacggatccggtcaacgccctgggtctgctttttgtgggttcgttctatctcgtggtcaataacataatcgagggtacttatgatggtgtccagaatcatattactaatctccggattgtccagataatcaattgcggttgtcgggatatctacgatttttacgtggatattgtgagctttgtaatattctagttcattcttggcacttcttttaccgccaagagcctccaaatcatagataaccagtgtgtcgccgggttttaaaaactgggttttaagacgctgatattcttctctgtccggtatttttccgtgaaaccgttcaattattatgttgtcaacagttgcacctgctgccatcagctttttcttatgagttgctgtgcggtacgtagatatgtaatagtaggttttgcttacatgttctatggatcctcctaattgttaatcttcttaatatcagacgcgtccggatattgccgtatgtagtaggatttgtccggccaccagatcatatgaaatggtggactttttggaatattattgccgggttactataattagcagagtgttatttctgttaatgcgaaatccgggtcactatctgttgagatgcggatagttcgcggtcgttcctgctgactgacagagtttcttcttattatgtgttgtaatgtaatattaactgtcctgtttgcttcttctggggttaacccaacgtaatttacaagcgcaaattccgttttttcaaggacctcgtcaagattcctttcaactaattcgctcagataacaaatctcattttccggcatgtgggcactccttccttttttgcaggtttgcaggggatctctaggctggtaataattacaggctgttaattttgattaatgacctgtaattttttattaactcagagcgtgtagtcaatgctacgcattctcttttgacgctaaaaactgttgattatattacaagctcttatttttatgtttcatctcgtaagtgatttttagcagatctaacagcccaaaattattttaagagccgttgatcttatttaatggtaaccgtactctatatatattataagggtacggttaccattagaactttttgtaccataaaatcaacaatcattaatgagctcttgaacgttagattttcctaaaagtaggaccggttagagacataattttaagagcttgtaaaataaatctgcggtttgtagcatcaaaacaaacgcttcgcgttgattactacgctctttgagttgataattctataagccgttaaaaagaaataatagcttataagatgtatcaacttagagctccccgacaggatctcatttttagtttaaaggtactttttctggaaaaactttgaaacatcgagccgattttcacgacccgtttatataacagggagaacgaacatctccttcagatctgataatattattataacagactgtcccaaaaagtctattggcacactatccaaaagctattgtatgcacaatttcataaattcatttaataaactgacaatatcgttcaaattcctataagaacaagtgcatacaaagttttatgctataaaagcatttttgttgtgaaatctgcacaagaatttgtcgcttctcctctctttttgtcttaaaaatcattcgtcattttgcacaacgaaatattcagatatctgaataaaaattgaagtatcccaaaaagcattccaaaagtaaaagtgacgaaaatactatttatccacataaatgctgtattttcaaagatttctatgatactatttccacataatgttatagaaaagaggtgttgtgcaaaatgacgaacgaaattgattttagcgaatggaatccagaccggcttgaaacggacggcgaagatctgatgcggacaatctatgcatatttctgtaataacggatacccacacaaactgcaagatgctattgacactgtcattcagattctggccactgaagataatacgcatctggagattgagtctttgataatggaacttgccggggctgctgatttgtggggatttcagcagggatttaaggcagccatagaaatgttatccggtaacacatttcgcaagatttttaaggaggacaacgaatgaataacgaggaaaaaacaggaaccattaacgagttgtatggtagcgtccaaggtattcacaattacgtagaaatctattactaccaacaagccagggagattgctgctgtaacagctattgcaatgttgcgagataatttgcctcctgctaatgtcaggatatgtattgataactggtatggcgtagaaatccccgaacatgcaatgaaaattttagaagcagaggcaaaatccgacgaggaagaagaacagcttaccggcaagaggagaacagatctctcaccatccagtctccatgatcggtgctgccggatccgcaaggccaagcgcatgtgtgaatgtggcgtgtcgccggatatcattcacagcgtttacccagagctttctgaggaagaaatcgacaatatctgttccagtgttgacagtgacaataccggaacagaggttgataacctgacacttagacaattgcaagaggtagtagctactcctctcaaaacaacagtagagcgcgtagcgtatctccgcggtcgctgggacaaggccaagaaagtcgtacaggatctatactgtaatcacggcggaaatagccatcctgtttacgactttttccaagactctgaaatcaaatatgaagatattataagctggaagatggaagccaaacaatatctggagcagaaagctatagaaaagcgcgcaaaagagactgcgctccgccttttacgcgccggcatggatccggctgccacccaagccagcatcaaggaatggttttgtgtagatttgtccgattccgcctttgaatacctggtaggacaggtagaaatagagaaaaatttttctaaaatcgctgatgcgatagaagggagacctggaaatgtcaatcaaaaaaacgaatgagtctgttgatagtatagacattatgaggatttctcaagaactaatcttgaaaaataggacagtatacaaacatcttgccgctgatatccctgttcaacaaattcttgatgaaatcatcccaggattaatcaaattatataaagatcacgtagttcaaattgttcagttcaagagtgacctggcatacattaacctggctgtcttatttgatgactcctatacattaaccatgcatcaatcgaaaatcggaaaaagccgcaaactgatgcgtgccataaatgagaaatacggacctgctactctcactataattaattacaggtatgacgacgtgcaagacccagagaaaaacagcactcatctttataaggcacggagtggtaaggcgatttggacccgcaaggaaacggaggaaaacaaccatgaatgaagatttaaaacatttaaaagagaaaaaggattttggatatggagatgcaattcgaatcaccggtgcggcactggccctaatgctacagatttattataaacgtattgctgaagatactgcctataacatgttaaaaaatgatctaggatttgatgatgatgccattgcatggatcagagcggatttggaaaaaatcctgtcaaaagcggattccgaggataaaaagaatgagtgaaaaaacaaaaactattgcggaattagctgattacgtccgatctgatctgccggtacaggaaataatagataatcctcaatatcgtcgtgcaatcgctggttgttgtcggtcatcatgaccaaggataacattctctccgccgccatcacggcaagacctttcaagagagagctcttgccgccaccacacggaacaccagctacaatgatttttccgaggtcagcatcctgtttttccacgatcactttgtaaagctctttcacagcctggagccgttcctggctccagcactgcatatatcctggtaatataccagttttcaaggccatctcaaatgatggcgctgtttttcttttcttcattatgttcacctactatttttctcaattaaatggtatttcctcatccattccagccggcacactcataaaatccggcgtctgaggctgcccgtactactgctgtccataaccgcctccgcgaggagcatatccattattattctgagcgtatccaccgcctgcctgctacctctgaccattgccataaccgcctgtcggctgaccatatccgccctgaggctgctgctggccattctggttctgtggattttccattttcggattgcggctcaaaaattttacggaattaaccatcacattaattccagtctgcctctgtccgtttttgtcctgataattcacaatctggacggatcctgtggcgatgatactcattcctgtagctccgtattcggctacataatcggctgtctgcccaaatgagaggcagtggaaatagtccacatgctccttgtcatactggcgatcacaggcaatattaaatgttgtcatcatttttccgttctgactctgtttctgttccggatcctgggccagacggccttcaattacaatattgttcattgtttcaatctccctttttctgtataaaaattgatttacgagttatttttgaggaatcgaataaatgttccctattacaagatgttatttttttcaaaaacagcaatttttgtttttggcgtttgcggttttttcaaatagatggaaaatttccggaagaaaatccggattatagaaagttcgttagaataaagtagaaaataaaaaaacggatagtatcagaatcaaaatctcaatttttccagagtcatcctgtttttgcaatttccgaaaaatgtacagagttgttccacattcttccaaatttggaaattgttggaataatggactgttcaaaaatccagtattcctgtgactcaagattaagatttttctgccagctgtcagctcttgatactgataactggactgattctgataccatccgtcaaaagttttttagataaagatgatatatatataaagttccttctaagtataaaataaaattaaaattgtttgaacatatattcgattttcaaagtgctatttattaattccgggtttcgcaatcgataataccaatcggaactccatataactgactatatgccattaactgcgcgtacgacggcttaactttttcattttcatgtccgttcagtgtagctattgacatatgaagtttttcggacgcttccaactgtgtcatctgtgcgtttactcggcaggctgcgagactccatttcaatgttttttcatcttccatccgtgtctgcctttctgtgctgtggtttacaagttacttataattttcctcaataataattaggtagttctaagactacaatatagtgtaggtaagaggctattgtctcctccttatggttatataataccacgggttttgtattttgtcaataatttttttattattcttgtaaatattttataattattccctcatattatgaaatccagatcctctaagtgtgatatgcaaaggccccgtcaattcatcatctgcagcctgttctatgtccatctcagatcctccatccagaacagagaccgcctccaagcatacaccggaactgtctcttttacatgtagtccgtccgtaggcaatggcataatccccaggcgtcacagactccgctcactgctgcgccagttcttcaacacaaaaaatagtataagatgtcctttctccaggaatagccagtgtaaactggcagaaactgctaacagtgccatccggcatgcggacagccttcaaaacaggctttatctccgcataaccagtctgcacacctagattacagtaaaactccttcttctttaccaccatatacaacacccctttcataactttccggtccgtttacgttccatcaaaacagccagacgtttcttgttcagttctgttcccacaaacggcttacctgcagcattggaataatatccaaccattcccctttcccatgcagggatcggcaatgcaattataatcaacattgttacagatccaacggatataatgttcttcatcgatatttttatccggatgcggtgcttcctcgttgccggcacgcacgatccagcatttatttttcctgccatggcaataaaagctgtcatcaatatggacgctggtgaaacgttcctgacatttttccagaatcagatcacgattactagcaaatacttctatataaacgtatttcagctcaatttcttccgctgatttcaaaatttctgtaaattcatctgcatatttatcagaaaattctttaacagttttctgacgaattgtttctatgctatttctattatcaatccaaaatcttgaatcaatcttttctttaacaagaactgactctacaattccggatacagcttctcttttaagtttgtaaactttatctttatagataaagcaataattatctttgtctccagtaacaaaatgtcaatagttttttaatcacttttttcaaaaataagcaaaaaaaatagaacacatagatttctctatacgctctacgttcagatttcatattaaatttttgcgtcttgtgaatcatttaccagtccttctagctctttttcatttttttcatcttcaacaggtttctttccggtaatatccttatatgcttctttcacaccattcttcacagcccacttaatgacaaaatatagtgctatcaaaataacaattgcgcttcctccacttatgcctaattcattccacataatcattaactcctccgatttcgtgactttcaatttattttcaactttacaggctgggatttatcattgaataaaccacatccatactccaactactataagcaatatacctgatattcttcctgcaaatttcgactttttatatcctagaaaatttattgtttcgggagttgtaaatggcaataaaacaacatctatacccattactataattccaattcctattatgaagacattattgttagaaataatgccataaaacataactaagaagcccaaaataatgcctaatataaaatacttgattttatggctgtctttatccaccatcttttcataacaattttcacatttactgttacaaaattcaaaattgtcatttagttttttaccacaatatttacattttttcatactgtttcctcggtaatcccccaaaattcattcaacaattcacgattttttgttctgttttttacatgcaagcagaaatttaacgttctcttttatgcctatcaataaacaacaaaacaaacataataaaccatatcccccatgcaatcaaacaaccaattcctagatattggatatctatgattattccaataataaaaggaactgacataaacatcattctttttccatatgccttacacatagcattctcatcgtatttctttcgttcatccgctgatttcatattataacccgacaagaaattagcagcttttccttctgatttataaaaccacattccaaacaaaaacataatcactgccatcataaagtcaaaaacaatatagatcatataatcatagaacatataatacaatttctcctttcaaccaatcactcttatctctttgaattttctacattactcctcatctttgaccaaacatagcaaatcagtatatcctgactgcataagtaattgcttaaaaccagaaagcacttcttcttttgtataattgttatttttcaaaaactcactatccttctcactaaggtattggtagaaaagagctgctgccattacctcatttctgtctgtataatcaatgctatctaaaagtatattctctgcttcgttaattttcccagaatcaatcatatcaagaaaatctttcaaatttttccctgatacttcatatttattttctttttcaagttcaacagaaacatactttttcccaaacattaaagaaaataatactcttaccatttcttttatcattcgcataatatagtctttttcgtctgtgaaatacatttttcacctccataactaccgatttctctgtttcaaaaactggaatttattttaatatccatggtcaacatgttgccattgtccgccatttgttctaactaaaatccacttccaatcattgtatgtactatttggattcagagaaccatctcctccagatgaattaatatcgaatgaagatagcaaaacaatgacttcatctgcattgttcctatctacccaatcttgatggtctttagagctgtcatcccctgcataataaatttctgtaagagtacatccattccagttgctcttaaactctttttttatggtgtcaatagcagctgcaatatcctcttcagaatatatttcagattctacattatgcgtgttaacttcattaacacttccaccacaagcactcaaactaaatacaagcagaatacatagcattgcacatacaatctttttcataattcacactacccccatcaattccgatttctcagtttcaaaaactggaagttataaacatctttgcaaatataccatatctattaactgtacaccacactcataaattggatggtcataattgtccgtaaagaaattcggaatattgtgagatcggacaaatccgcatttttcataaaacggtacggtcaacgggctgtcacctgttccaacctgcaaaatagaatattcatctgcatatttacttgaaaggaagtcaatcaatgctttcccatagccctgtccttgattctgaggatcaactgcaatatttttaatttcaagtattccattatcttcatcagtaacgacacattcagcttttacattaccatcttcaagtacatacatagtacctttttcaagatagtaatcaatcatattttcctgctcatcagctaataacaataatgctataaattgctttttattctcattcacttctcggattttcatatttattactccgtcaaacttgaagttgtcagtttagaaaaccggaagtcaatcaaataaagcttcccatttttctgattgcattgcattaaaacacattgcaatttgttctttattattcttttcttctgcaagttctggaagctcatcaattccaaaataatcaaaacctgttgtttcaatattcgttttaaattgaccgcccgtcacttcacattgcataaaaatcttacatactttatacgcatatattggaagattatgtttctccctatcttgaacagcaatcacacgttttacagtaacatcaagtcctgattcctctttgacctcctttattgtattctcctctacggaaatatcgacatcacaccaacctcccggtaatgaccaagtaccatttgcttcatgaaccaataatattttcccgtctttaaaaatcgcagcccttgtatctattttaggagtctgatatcctacatcactgcaaaataaattttgaactttttctgtagatatttcagttttatagcttatcatttcagcagaaatttctcggattctttcatatcgttctatatcaaatttgtcctttccataaaacaaaccaccctgagcaatagcttgtaattctactgcccattttagccattgttcgtttttattcatagattatcgctcctttaaattccgagttgttaaactctttctaacctccatcttcttgcccttcggacaagaagtatccctcgctctaagagctcggtcaattccgattttttactcacataatatcacacttcttctacagttgcatctatatattttcattacacttccattctgctcgcttctgtcaccagcatccggttaatcttctcctgcatggtttcttttgcatcctcattaaagtgataacggacaacattcataatatttcggaaaggggtgaaatcatcatcctcccgaaaactatctgcattctcattcactgcgatcagacgcacattcttctgtctgagcagttccatatattgcccgaccttcagataatcccttcccattcggctcatatctttgatcaggattgtcccaactttcccggactccacttctttcatcatggcaagaaagccggggcggtcaaatcttgtgccggaaattccatcatccgtaaaatgaatcagatttgtaaagccatgttctttcgcatactgctccaagagcttcttctgattggaaatactgttggactctccgtttaattcatcatcacgactaagacgctcatacaacgctgtcatgaatccctgtgtctgtgccattgtctgacgccctcctttctctaatttggctcctgttctcaccccatatccgttcctgtaccgggttctgatgtttccgggacgtatttccagaaaaaatctggtatcaatatgggcaggctattctgtttccaaggttcgtgtaagaaaccgaaaaaatttccttacacataacccattgctcagacgcctttttacagggtcacaacataacttttctcattttcctggatttcgtgtcggtaaaaaagtttcttacactctacacaggtggcagagggtaaaaagtcatattgctttgaaatgtttttaaaaaaatacaattttgccctttgaggtaaaaaaataagcctcaagagactttttaatcaattaggagctccaattctctaaaattgagtgattaagaagtctcttcaaacttactacaccattgacaacctgggctcttatagtcgtcgcctaggctatctgtttctctgacccgagtaaatcgggccagatcttttcttctgctgctttcacagcttctgcttgttcagcttctcttttcttcagcagagcttctctcttgtagtccggataaagttcaccttcaccgagggattcaacataccgttctctacttctgctacttccactaaggtttcttcttccccagtgaccgcattctgtataatagatagatgtcattgccataattaagcctccttatcctttctgtatacaccagctgtcatcaatacccaacggtgctctatttcacttttgcttccttttcccgctccaccaaaaaatacatttaagtcttccattaaattatggacattaatggggatatctttaggtacatggcgtaacagtcttaatgtagcgtcctcctgcatgtcgcgaccacagtagtaagaatcatttcccgctatgtagtcaagatgacgcatcattgggtatttcacattattcggaagagttgctattcgctccggaagctccatagagccatctacgcaatgctggttcaagaagatcctgaggcactgatgcattacagtttcaggcagacatccaaaatcaccatctgtcacataatacagtgtatatccgcgtccagtgaataagtttcttttgttgtagttgtcaagatccttaactctaccaagtacctctgttacatttaattcctttttcattgtttcctctgtcataattcattgacctccattctttagtaaattatttttcacatccattagttaagttctgtttccaacggttcaggacttctctgattgcattctcatcagaccgatcgaataaaatgtcaaaatcttctatcaacttttcaacatccacttttacgtctgcacgatctttcgcaaacatttttccgattatcatatgttctgcaagcccacaatggtaagcggttgttgtgcaatcagggtcgagaatattcagaatataatcaagatgtttttttcttccattaggtcccatgttatagaatgaagccagtttttctgttaactctacgctaccatttacatatccctgcttcttatacatccttaagcatcgatgcataattttcacaggtacatgaccgtaatttccctttgtaggctctccacttgttataaaattaagaaaccaaactatatcttccgtcctatcgccatcaaagtaacggtctcttacgtttccgtaaatcctttttgtacgttccaggatttccgttatgttcagaccacttttggtgatcttactggtaatactcttcaaatctcttgccataatcagtaagagatttccctcattccactctgcaaaaaattcttcaggctgcttcttatagtatttaataagaagtttctcattttcttccaaaagatcttcatggttattcagagtctcgctttccggatcctgatccccaaacagatacttagctgcttcataatcagcttcagcatctttcgttgtcttcaggtcaagaaccaatgctcttgtgtcgatttcctcaaaatagcttgttacggtttcgattgcattctgttttgtcatagtgcttatttgccggatttttcctaatccgactctcctttctttattggtcaggagggacttccctccggtgtgtcattaatatcctctgttcatcacatactctatatgtccagggattgagtcaagtatttcctgcctctcctttttactcctgcatgttgcgtagtgccgcaggcattcgcacgcaaggtccagatttgccctggccagagtgataaacggctgaatcgcatcaaagtcgtctttgtcaatcagggttttcaagtaatacctgaacatcggtttaccggatctggtaggaattctttttggtgtcataatttggtctcccttcttaatttgtgcttattttttggtaacaaaaaaaagagcggtcactacgacaaaaggataatttgcagaataagcttatagacctgtaccagtgactggtactgattctttccataagaaatataactatagagaataaacacgcttcatgtacttgatgctgttttactcatccacagagaaacttcctatagataaagccttattctatttttattccttttgtcgtagtaaccgctccataaatcttaacatcagctgcattaaaaaatttacatcagatgtcgtgcaatatgctcatgttatggatacgcctctcatcaatgattttcatacctcctaaagatgattcatcactgcgacgtatgtatttatttgtattgccaaaaatatttacttacttaaattatatatgtatgcttttcatgtatgtatacgctttcatgtatttttgtttttatgtatgtattctttatggttatactatagcacttccatatttccttgtcaataacttttttattattttcatttattttttctaatagtcataaaaatattattgatttctaatatgtaatgttgaagcaaaaatagcaaaaaatatatttggttaaattaggtcaagttttggatacataaaaagaagaggacctgaagatcctctcatgcataaaaattcttattcaaattgccattatagtgttaaaaacaaattataataggaagaaattcctcaaaactgatgccctttttcgtcaatcatgttaagttcaatcacccgtgcccgcaaacccgcataaacactggacttttcgtaaaacgtcaaatattgcgatatcaaattatatccgtatgtacgcaaggttatttaagctgacgtgggtactgatgtccatcgtaatcctgtgcgtgattgcaatggggctgtacgccattctggattttattgaaaaacgtgcacagaaatggtaactttccttaaactactaccgtgtcaaggacattggtagtagtttctcggatacactccaacaaaggaaatctgcggcagaactctgtaatcgtttagtacgattctgatttctctcacgttttctttaaaaatcggaatgatttttttgtaaccgatcacggttccggtatagactttctcccactctccctgatcccttacaaatacttcaaaagcctctactctctggctgtaccggatttcttcttttaataccagatacccggcatcttctgcttcatccagtgcgaagacaagttccaccggcctatgggattcttccagcaaattacgagaaaagcttcccttctgccattctcccagttccttcaatcgttccacatcattctcatgcaaaagcccgttcggcatcggcgggatattcagaagaaatgttgcatttccaccaacagaacccagataaatatggaccagttcctccaggctttttacctgatcatcctcttccgaatgataaaaccatcccggccggatcgaggtatttacctctgccggataccagatcagggcatgttcgccttcaaggacggcacggcttccaaggtcttccatatcactggtgatcttcctctggcggaattcttcatcatccgactgctggcttctttcttgaacactttctgccagggctgtcctcgcaggaactacactccactcagattttcttacatcgccggcttcatttccacaccaccggatgtccggtccgcagacgcagatgcaggcctctggctgatagttccgtacacatgcataatatctctcccagttataaacctgcttctttccattcggaccttccccacaggccccgtccagccagacactgaagatttccccatacccggtcagaagttccgtcaactgtgcaatataatagtcgtcatattctttcccgcttccataacatggctgattccggtcccacggagaaagatagattccaaacttcaatccataacgacagcaggcatccgagacttcctgtactacatctcctgccccatccttccatggacttgaagcgacactgtgctgtgtatatttcgtcggccacaggcaaaatccgtcatgatgcttacaggtaaggatcacgcctttcattcctgccgccttcaccgccgatacccattgcccggcatcgaattcctgcggattaaaaattccgggatcttccgtaccgtctccccattcccggttcgtgtacgtattcatcccaaagtgaaaaaatgcataaaattccgtttcctgatacttaagctgacgcttcgacggaacaatcttaatcaattcctggtctgtcggcatatctcttctccttcttcaaaaaaatccaattcaccctttcaatccgcctgcaccgattccctgcagcagatatctctgcccgatcagataaatgatcatggttggaatcataatgatcacaagtcccgcaaacagtgcgccccagtctgtcgcatacttctgtacttcaaacaaatttgccattccgatcggaagtgtcttttgggcatcatcggtcaggaggactagtgccagcggatattcattccagaatcccatcgcgctcaacattgtgatcgttgcaattcccggttttgcaagcggaaccataactttcagaagaagctgaaggtttgtggcgccatcgatccgtgcagattcttcaaaatctttcggcaccgcagacataaaaccctgcaaagtaaagatgcagaacgggaactgcatgactgcatagaccaggcagagtaccggcagattattcagcccgttgatcgcctgtaattccagaaacagcgggatcatgatatacgttgcctggaggaaaatacatgccatatagatcgtcgagatcagtttgcttccggcaaaacggtatcttgccagtacataagaaatcggtatgacaaacagcagaagcaatgccgtagacagcactgtcacaaacacagaatttccaaaatacgccgcaatatttgccttctgccatgcagcgacaaaattatccagattcaatgataccggcagcgcataaggatctgtcagatattccgcattcgtcttgaacgcagacatcaaattccagaaaagcggataaagaaaaataatcgtaaacagaatcatcaggatcctgatacaccaggttcttacagttttcatcagtgtccctcctattctttctcagctgacagttttcgtgagatcatcgcaagcacgattgcaagcataagcgtaaacatggcgatcgccatcgcatagccaaagtttgcattccgcataccctgcgtgtacatatactgcagaaggacactggaagcaccgttcggacctcctcccgtcatgacattggacagggtaaaactcagattgatcgttcctgacagagcaaggatataagtcgttccgatggacctacgaagaagcgggatcgtgatcttgaaaaacttctgggctccggtcgctccgtcgatcgaggcagcttcgtaaatttcctgagagatcccgtcgattgaagccacatgcattaccatataataaccgatcgcttgccataccagtgcagcaccgatacaccagagcgctgtttttccctctccgagccaggcatgcttccaggaagaaatgttaaaaagatccagcatatgattgaggattcctcttgtcggattaaatacaaaagaccacacgattccgacaacggtcatagagacaacacttggaaaaaagaataccgtacgataaaaagatttctcccggagctctccctgtgtaaggatgaaagcaaataccaggctcagaaagatcgtcagtgccggaatcacaagcatcagtttaaacgtattaaaaagtgcctgtacaaagtccttgtctttgaacatataaatataattatccaggaatacaaacttactgttgaatccaacactgagcgcagtggaactggtaaacgacagatagatggcattcagcatcggtacgatcataaaaacaatcgtaagaatcaacgcgggaagcgtacacaaagctataaataattttggcttttttaccacgtctggtcactccttttttcagatttcaaatcattttggggtaaaaaaaggctgccgcataccttgtgcagcagccttttcgcttaatcggacaacattcattctgtaaataacaaaaaagatatttatttggcagcttcctggtctgcacgaacctgtgcaaaagcgtcctctacattctgtgcccactcttctactgtcatttcatcgttcataacagaagtgatcgggttaaaaatctcatcttttggattgatcttgcagtcagccggaactgctgagaagctcatgatcagagaagaggcatttgcttcgtcatagattccgtacatgttgtagattgctgtagaaagtttgtcttttgccacttcacgggcactctttgttgcgtaaagggcaccggaagcttctgcaaatgcagatacagattcatcgctgtacaggaaacggaggaattcttttgcgagttcctgattctttgcagctgccggaatagagaactgctcgcagctgtcgaatacatagtgaacatcatctgcattctctgtcgggatcggagccatggcaaactcaaatccgtcttctctcggagcatcctgcatctcattttccatccaggttccatttgtgataaaagcagcttttccaagcatcatctctgtctgggattctgtatggttcatacctactgtaccttccagaagatatcccttatctgcgatctctttgatatgagtgagggctttcagcacgccttcattattaaaggagccttcttcataatttgcgatctttgtgagagcttcttcaccacactcatttgcaattgccggccagagcatttcttccatatatcccggatagattccctgataagtaaagagggaacgtccgtcgatatctttgactgtatcaccaagtgcaaagaactcatcccaggtcttcggaacttccagattgttttcgtcgaagaatgtcttattgtagatcaggccctgtggaccgctgttgaacggtgcgagatagatatcgccatctccatatggtgcacacttgctgcttgcaaggattccatctgtgatgtcatcacggagtgtaccggttcctgcatagttttcgccatcaaaaacatcgttcaggttcagaagtgcatgttctttgatcagagaaaggatcacgccgtcctcaccgccatcattcaggcagataaaatccggtacatttccggcaacgatctgtggacgaatgatatcaccgatggtagggctgatggtcatgtttactttcacgccctcatgactttcctcaaagagttctaccatctgattccagtaagcatctccgtatccaccctggaagattgcgatgttcagttcctgttcttccgcgtctgcaaatgcagtgagtggtgagagtacgctagctgcgctcatcgcaaggatcatagcagaagctgcaaatcttttcttcatatgtttgtttcctccttcgttctggcttttttacgttcgccttatgatgacagtatacggcaaaatatttttgtagtaaattaacaaaacaaccctgcttatggaactttttcttgtaaaaattatatgatatagattttcttgtgataaatatgtacaatctttttctatttgtgttttggatggattatcctgactttttttagtataatggataaaaaggcggggagaaaaatgaataaaaaacaacgttatcagggatttcgtaaattcagtatcaaaacaaggcttgtcatcgctcttttgctgatatccattataccattggcaggaatcagtggctattcctttcatatcttttccgtagcactccgggaaaaactttctgcttccatttctcagactttatcgatgatcaatctgaatatggtaagtgagattgaaaaatatcagtatctgtgtggctctatctgcatcagcgaagagatcaaggacgggcttctgaacaaagatatgtcagatattgagaaaaatcaggcgatcaatgagatccaacatatggttcgcaccaagatcatctatccggcacaggccaaaaatatcacggtatacaataccgacggaaatattttttatgaccttggctatgacggtttctatcagaatgatgtggatatactccttgaccggctgcgccaggaaaatcaggatgtatgggcgtatgtgcacacctaccgcgacagagatatcctggtccttggaagaagaatctatgagcagtacagtgaaagccgcgtcatcggttacaccctgatttccatcgatgagaagattttttccaagaccgtgctcgaaccggtagggctggcagattcttctaatattatgtatatgaatatggacggtactgttctttcctcttgggaccgaaatatcgcactcggtgaaaaggttgacagcgaatttctcaaaaacatccagcagaagcttccttccagaaccgattccttcagcatccacaaagatggcgaagaacagctggtcacttatattttcaacaaaaagctcaaccagctttttgtgtacaccatgccttatcattatatcaattccgaagtttataccatgcttcgccgaatcctgatcgtggcagtgatcctggtcctcacgtgcatcgggatcgtcgcaatggtatatccgggaatcacctccccgatcagaagcatgctggatttctgtaaagaattatcccacggaaacctggatgtccgtattcaggataaccacaaagacgaactttcagacctgtccggcagcatgaaccacatggcagataccatccagaatctgctcgaacagcaaaaagaacaggaaacgaaaaagagagagcttgaacttcagatgctccagtatcagctcaatcctcattttctttttaacaccttaaacagcctgcgctttgtagcagccatgcacaatgatcagattgtcagcgatgggatccaggcactcagcagtcttcttcagaacacgctcacgaataagaatgaatatatcaccgtgcaggaagaacttgaaaatttggaaaattattttgccattctccgcatccggtatgcaggaagtttcgaatattctttccatgtggaggatgaagagctgctctcctgtctcgttcccaaactgatcctgcagccgctcgccgaaaattctgtaatgcatggttcttccgatgacggttctgtcatggagatccatattacctgctgggaggaagacggacatatgatcctggaacttcaggatgacggaaaaggattcgagatgactcagactgatctgaacccgcacaaagaccgcaaaaaaatcggcgtagcaaatgtaaatgatcgtatccatctgaactttggccggaaatacgggctgaagatcaacagtcacccgggcgagggtaccacctgcaccctgacactgccagagctttatgccgataccctgtcacaacatccagaagaataaacaagtacctcagaaaggacccaaatgtacagtatacttattatagatgatgaacccattgtaaaaattgctctccgctcgatcctcccctgggaagaacacggtttttccatctgcggaactgcttcgaatggtctggaagccatgcctctcatcgagaagcatcagccggatgtgatcatcactgacctcaaaatgccggaaatggacgggctggaactaatccgtaccctgaaagaaaaaaattatcccggagagatcctcgtactcagcaattatgaagattttgattctgtgcggagcgcacttcttctgggcgcggcagactatctgttaaagatcaagatcagtccggacacccttctcgcctgcctgaacaaaacgaccgaaaagctgcatgaaaaagctgacaggaaaatttctgttccagcggaaaccgtatccgaaaacagaacccgcctgctcctctccttttttgagggagaatcttccctttcctcttttacgatccaaaacgccggcacagacctgcgctttatgcaggaaccatgcgccgtctgctatgtgacctttgaaaaattcctgtccaatgaagctttttctatctcgggaaaacttctgtgtgatatgattctggacgcagtacagggtgtactgcagccatatatccttgtactgaacgactacagtgcactggtagtcttttcccagaaagaactggatgcaggccagatgaaagtcgctcagctcgtaaaaaagctgtacaaccgtttcaccatgtaccagtccttcgccccggatatgccatatcaggaaaatcttccggactatgaggaagccagaaatacctatcagacctttaccataaatgaaggacattatacagacgatattgccaaaaccctcgcatatatcgaagaaaattacatgcaccggctcacgctgtcctccatttccgcaaatgtcagcttaagttccagctatctgtgccgtgtttttaaatcagaagtcggaacaagcatcaccagttatctgaacaacctccgaatacgaaaagccgccaccatgatcaaagacaaccgactttctctcaaagagatctccacaatggtaggaattgatgaccagctctatttcagcagactgtttaaaaaatgtatgggaatttccccttcggaatacgggaaacgatttcatcagtaaatctcaaaaaggtatgaaaccacagatttagcttctatgatctcataccttttttcttatcacatcattcttctatttcttagatattttcgcttctcagatctgataccacttgatctcatttgcttccatgtgaagttcgaagcagcttccatcgcctttgtatacaacagtatcctgcggctcgtaggtgttgtttacgacacagtatttgccgttctttacataggcgtggacttctacattgtaatttgtggaataccagcagttcagttcttcctctgcagatgcggaccagaggactgcacggtagaggacacggctgttcttgaagctgtacggaagtccgctgatatagacaccacggccttttccgaagttcttcactgccatctgcacttcctggtctttctggatcagaatctcagttccgtcaagtgcataaatatttttctttccttcaccgaaatcaacgtctccgtcactgtctgacaggataaagtgatctctatgttcttcccagttgtatttgtctttgttcaggttgaagccgttttcttcttctactccaagtacatcgtcaagctggaaataatgtccctgccactgatgggctgccggttcgccgactccgatgaagccgccgccattgtagacaaattcttttactgcagtgatgatcgtttcgtttacccagtactcgccgccgctttgtgcagtatctgcatcgcctacgttgatcacaacatcaaagtttttcagcagatccttattttccaggatatcatcaaagctgatgaaggaaacatcaaacggtgcgccgctcaaagcctcgatgatcccgaaataagaataattctgtttataataaattgcgtgatgtaccatgtggttgccccaggagcgcattttaccccagcagttcaggaccgctacacgcttcacacagtatggggtcacaccctggatgttatcatagagtgtacggaattcctggcatacctctttgatatactgtacaaaatccgggaattccagggcaagtttcaggtatccgccgtaaccgattctctggatcgggcttcgaaggatcgcacgccttgctgttacccagtttactttggcttccttgaccggatcgccgccctcatggaaggtatccgggaaaaagtacggaaggaaacgtccttctgtatattttacattcttgatatcgctgaacaggcgcaaggtcgcaccgtttccgacacttccaacgacagcatccagtccgattgaagcaaactcgtccataaacggctccataccgatccagtgatcgcccatgaacatcatagcttctttgccgcattcatggacaatgtctaccatctctttggcaagcttcgcaacttctcttctctggaaagcctggaagtccttgaattctttggatggaatacggtatgtattattcatgtaaccctgatcgataatatattccgggcggaacgcatatcccacttctttttcgaattgttcaaggatatacggactgacagatgcggagtaaccgaaccagtctacatatttttctctcgcaaactcatcaaagatcagggtaaactgatggaaaaatgtcgtaaaacgtactacatccacatattgatgcgtatcaaggaaacgacggagacgctccagggaatgtgctcttgtcttcggctgacgcacatcaaaagtgatctgcggctctacgtccttccagtcatttacgacagcattatacatatgaaccgggtcccacatgatatatgccagaaagctgaccgtatattcatgaaaaagtttcgccggtgcgatcacgacatttccactctcttcgtcataagaccaccgatctgtcggaacgacttcgcctgtggtacggtcaatgacttcccaccatctggtgatatcatcacgggtatttactttcaacatgtccgggtagagatggtccataaggttgatctcaagtttctcctccgttgctgtatggaaagaactcatgatgtacatctgctggatctcatccgggtttgcctttgcccatgcattatcttttcttgttgtataataagtagcgtagatctttgcacctgtgtctttgagttctgccgggaactctgttccatcgcagtcacgaatcgcatctgcgccccattcctctacgatatccagtgtttcttttaccacatccaggtttgtcgggatcgtaactctgcctttgttctgactcataggtgtacctccgttttatatttatggatttcttttatcatctgtttttgttttatttcagatactatcagaatacgttgtttttgtctgtttttcaacgttgttcttgctatactttttagaaatcttgcggtattttatcttttgtgctatcctgacagttgaaaaacttttcggtcctgggaggtacatatgagcacacagtttttttctttttcagatgatacgcctttttcaacagaagcagtcctggtgaacgcctcttcttctcattatgaggaagactggcccagcatcccacatacccatgccttcacggaactcttttacgtcagtgagggaagtggagaattcctgattgaaaaccagcatttttctattaaaaaagacgacctgatcatcgtcaaccctcatattcagcacacggaaatttccttaagtgcctcgccactttcttattatacggtcggtgtggacgggatcagtttttcctttcatgaccagaaggaattccagatctttcactaccaccagaagcacgccgaccttttattttattttcattctctttttcaggaactggatgaaaaaaatgatggttatgaagagatctgcaaacacacgctggccattctgatctctcagctccgtcgttttgctgtctctgattttcagttgtttccatcctttcatccaagcaaagaatgcgcccttgtcaagcgatatctggattcccactacagcgatgacatcaatctggaacagcttgccagcttaagccatctgaataaatattatctgagtcacgaattcacgcgctactacggaatctctccgatcagctatctgacccaccgccggatcgaagtatgcaaaaatctcctggagaatacagaccatgaaatctcggatatcgctcatcttgccggattttcctcgcagagttatctggctcagagtttccggaaatactgtggcatgactgccggagagtaccgccgcagcaaaaaaaatcaaacgatatgacagatggtatctgctttcagcattattttcttctcaattccgttgtacaaaagtatgcgtaccatatctgtctgtgattgcagactgcattctgtaatgcatctgtctttccatgcaaagtcaatggtaatgccgcccggtgccctaaggccgcttatctttccatccttccattcctccggaagcgccggaagaaagaagatcctgtcatcctgatactgtaccagcatttccagcacagcagccgcaaacccgaaattcccgtcgatctgaaatggcggatgtgcacagagcatattcgggtaggtcccgccgccaaccagactgcagttttcttcttttgtaacgtgaagctgatttttcaagagcttcaacgcacgctctccatctccgagccgcgcccagagacacgccttccatgccatgcaccagccggttccctcgttccctcttctgtccagagctacgcggcaggcagccagaagttctttatcttctctgtggatcagatttcctggataaaggccgtatagctgtgaaacatgtctgtggtgcatatccacctcaggatagtccaggtaccactcctgaagctgtccttctttcccgatcttaaatggcagcagttttttgagtgcagcttttacttcatccataaggtcggtgatatcaaggatctcgcaggctttcagataatttccaaacaattccttcagaatactgcaatccattgtcgaaccaaaggtcacactatggacactgtgatccgaggctgtaaatgtattttccggcgacgtggatggagcagtgacgaggtatccgtcataaggcaccagatatcccagataaaattccactgctccccggataagcggaaaggctttttttctcaaaaactctctgtccagtgtataacggtaatgctcccacagatgactgcagagccacccggagctcatcggccacatagagtaggtacagggattttcatcctgcccgaaatatccgaccgggctggaatgtccccagatatccacattatgatggctcacccatccatccagatgatagacttcttttgctgtcttttttccatgcgaggcagtccgttcgatcagatcgaacagcgactcatggcagtcgcttaaattcgccttctctgccatccaataattcatttctgtattgatatttaccgtatagttgctgctccacggagctctcaagttatggttccagattccctgcaggtttgcacactgtgtaccaggtttagaggaagagatcataagataacgggcatagtgaaacatttttgttataagatcattctgtatgccaggattcaacgtaagatccatccggtcaaaatatgctgcatatgccttcttgtgagcttcctttaattgtggatatgaaaggtcacaaatctgttccagcatctgtttctttctggataagtaggagtcctgtgcctgaaaatccgttatcccggacagataaatatacacatcaccatctgcagttacaagaagcgtgttgtctttttggcgaatacagcctttcggtgcctgcacggaaataccgattgcaaaccgtattccttttccttcttcatagacgatcggctgctcacaggaataatacgacggtgccgcatagaccggagcctgtccctcaagcacaagttcacttatcccataaccagaacagacatgtcttatctggctgtccagagaaatacgcagttccagaccgctgcctgcatctgctctataatgaagtgccatgactggttctgacatacttacaaaaaattctcttagatatccctgtccgtcctgacgatatacaacctgttccagcgcatctttaatcgaaagctgtctctggtatgatccatgctcttttaattcaggtatatttgcatcaatatgcagatttcctgccggaaggtagctctctgtccaatcaccaaggatgttttctttacaataggcttccgcttcttcatactctccgtcaaagatcttctggcgcaaaaaatcccagtccacatctgtatttttgttttctttgcttcttccggttccagaccagagtgtatccagattcagctcgatcttttcctctcgaagccgtccatatgacatcgctcccatagagccgttccccagaggaagtgcctcattccatgcttctgccggtctgtcaaaagccagtgttaaataatccattccattttccctcattgaatcagatttatctctgaacgtattttcagttccatcgttttcacaatcagctcatttcaaaagcttttcctttcccttcagaggcagtcctgccacttctgccagccggtcaattcttccattgtccagccgaattccgaatggcacaccaaaatgtgtgattttcagatagccatcctcttccttcaattccggaagccgattcatcaattcctttttttccatctgcaggaatttctctgcccactcatcacagagtttgatataattggatgttctttcctctgccacagtacaccctcctcatatgacttttctttttctgtattatacctctgtcagacatttttccgcaagaaaaaagaccttctacagaaattcattttccatagaaagtcttttctttgttttatgctttatgaggattttactttattccagagatcgccatacacctggtcagcctctgttccaagatactggaatgtttccagattatcatatttggaaaggtccgggaatgcgatctcactgtttcggatagattcatcctcgatcagttctctcgcagcttcattcggcgtagaatacgtaatgtattcaaagttcatcaacgcaatatccggtctgcagaggaaattgataaatttttctgcattttctttatgttctgcatttttcgggattacccaggaatcgatccagatattggatccttccttcgggatcacatactccagatttgggttttctttctgtgtgtaaattgcctcaccggaatagattacaccaagtgcagcttcatttccgatcattttatcacgcacctggtcgatcacatatgcctgaaccaacggtttctgttcaatcaacagattttttgcctcagtcagctcgtccaaatctatagaattcagagaatagccaagatatttcagtgtcacgccaaatgcatcacggactgaatcctgcatcagaatattatccttgtatttcggatcccagagaatagaccagctgtccaccggctcatctaccatcatcttgttatacagaatgccgacagttccccagcagtatggcacggaatatttattctccggatcaaactgccttgaccgctccagatactgtttcccgatatttttaagatttggaatgttatcaaaattaatctcggaaagcagatcattttcaatcattcgctgaatcatataatcactcgggcagatcacatcgtatgcgatcgcaccggaactgatctttggatacagaatctcatttgtttcaaattcttcataaacaatatcaattcccgtttcttcttcaaacatcgtcaggacttccggatcaatatattcgccccagttgtatacaaccagtttctctccattcatgacatcgttttcttttgcataatagaaaccaccaccaataaagacaatacagattgcaacaggaactacacgctgaatcaggatctttttcactctggaaggcttgcggacttttttctttctgaccacagtttcctcttcttccttcggtgaatagttgatcaaaaggagcagcaccagaactgtcacaaacatgatcgtagaaagtgcatagatctccggtttgatccctttacgaacttctgtatagatttttgtggaaagtgtatcaattccaggtccttttgtaaaatgcgtgattacaaaatcatccagagacatggtaaatgcaagcataaatccagaaagtactcccggtacaatgtccgggaaaacaactttaaaaaacgctttgaccggtgatgcaccaagatccagcgcagcctcatatgtataacggttcgtctgcttcagcttcggtaatacgcttaagatcacatacggaatattgaacgtaatatgtgcaatcagaatcgttccgaagccaagtgtcatatgaaatgcaataaaaagaagcatcaaagacacacccatcacgatctccgcgttcatcatcgggatattggtaagtcccatatacatggtcttccacttctgcttcattccctgaatcgcgattgcagcggccgtgccaatgaccgttgcgattgcagccgaaacaaacgctatgataagtgtggtataaaacgcgctcatgatctgttcatttttgagaagttctttataccatttcagtgtaaatccaccccattttgctcttgtcttagactggttaaaagacagaacgatcaacgttacgatcggggcatataataaaataaaaataagggccaggtatatcttctgtaaatattttctgatcaaaatgccgcacccccgtcctcattatcgtattttgccacaagtgccatacttgcaatgataaataccatcagtaccagggacagaccacttccaacatgccagttgctgttctgtttgaatgactgctcaatgacattaccgatcagaaggatctttccgcccccaagaaggtcagaaataacgaaggttgtcaacgctggtacaaacaccatcgtaataccgctgatcacacccggaatactcagtggaaaaatgaccttccagaaagtctgtacggaattggctcccagatcacgtgctgcattgatgacatttctgtcaatcttgatcagtacattatagattggaagcaccataaatggcagaaaattgtataccattccaagaatgatggcatatggtgtattaatgatctccagcgctggtaaatgcaggaaacttaaaacactgttgatgacgccattcttttcaagcaatgtctgccatgccagtgtacggagaagaaagttcatccacattggcagaataaagatcagcacaataaaacttgtctggtttacctgtttctggctcaggatcattgccagcggatatgccagaatcaagcagattgccgtactcaaaaatgacagaagaatggacatgccaagtgccttcagattctccggtgtcgtgatctgtgccagattggaaaatgtaaaactaccctcatcactggtaaatgcataatacacgatcaccaacagcggaatcactacaaaggacacggaccagaacagatacggaccggcaagcaaacgcttattcttcaatgtttaccgcctcctcatcttccgattccggttttttcatgatctggatatcaaacggatccacatgaatgctgacttctgttccaactgggaacatatctgtgctgtgcaccagccactcatagttgttcgccatgacttccatctcataatgtacacctttgaagatcatatgtgtgactacaccatcaatgcttccctgccccggtttcagaagatcgatatcttccggacggatgacaacgtcaaccggtcggttctgtccgaacccttcatccacacatggaaaattaacacccagtatcttaacaagacgatcctgcaccattgtcgcggaaatgatattactctcaccgataaagtccgccacaaaagcattctccggctcattgtagattttttccggtgttccgatctgttggatatacccctgattcatgaccacgatcgtatcagacatggtaagtgcctcttcctgatcatgtgttacatacagaaaggtgatccccagctcatttttgagacggatcagctcatactgcatatcctgtcgaagcttcaggtccagcgcaccgagcggctcatccagaagcagtaccttcggctcatttacgattgcacgtgcgattgcaatacgctgctgctgtccaccactcaaagaatccggcatgcgtttctcaaaaccatccagattcacaagcttcaatgcatatttgatcttgtcataaatatactgtttgcttttattctttatctttaatccaaaagcaatgttatccgcaatgttcatatgagtaaacaacgcatatttctgaaatacggtattcagctgacgcttattcgccggaaaattcgtgatatcctgcccgtcaaagatcacacgccctttatccggtgtctcgaatcctcccaaaatacgaagtgtagtagtctttccacatccactcggaccaagtaatgtcaggaattcattctccctgatgtaaagattcagttcatccagaactttctgcatcccgtaggatttggaaatgtcgatcaagtcgatcagcttattgctcattggttgttcctccctaaaaagtatcccctctttttcataagaaaaattattaataacaactttatttttgtatcataaaagcgttacgatttcaatagattttgcgagattttaacataaaataatacggtacttttaagatattctgatctttttccgtacagtaacaagattttctgtacagttgattttcaacgatggtttattgtccgaagcaacgctcaacgaaagattacatgtttttcctgtatcactctctattgctgcgatcatctcttcacggataaagccagctgctgtggatttttgccagcagtcttgcattatgatatgccatttttaatgtcagacatgtcctgcccagatatttgctcccatcctctgtctttacacaggcaagtgccagatcagctctgtccggattttgcagacagacaggaatgagaaactggattccatggttataatactgcggaatggctgtccgataatcggcctcaagcattctttttgtctgccgcagggcgccgtcaaacagttgtactttcatcacactaccgcgaatcgtctccggaagtctctgacaattctccgtttcttcaaaaatatgttcatactgaggcacgatatccagtccggtatcaaaaataagttctgccggatctgttacatatgctgcacgtttcggaagattgacaattcctgattttaataaatgatattctgtgtagaagccgtccagaaaccatctctgcctgtccggcaccagatttgggataaaatatgcgtagaccggctgataatacatattaaaaagtcctgtattaaaaattgcgtattcctctgtctccagtaatttttcttcttcatatacccgctgaaatgtatgctccagataacctttcaggattccattgtcatcattgcctccaaaactccatttttccgggacgattctggccagattctgtatctgccggttgtagttcccgcagtacgtgtactcaaacagattcaattattttacctcctgcattttgattccattacttatattaatattgtatttgggaaaatctccgacagaactgccggtaaagaatatatatagaaaatagcacaacttttcttctgagacaatttcgagttctgtcgaaagatgtcttctttttattatttgcgggattatgcctgtaaacactactggttttataacctccagatctgctttgtatataaataaggttgaatgatttttctatagtaatcccacatggtacatgctataatagggaactgaaataagcactttccgacggaaatgcggagcttacaggtaagttgcttatatatttatttttcaaggaggcaacgaacttaatatgactaaagaagaatttcgaaaactgactgagaatatactgattctggatggtgccacaggctccaacctgatggcaagtggtatgccacgcggtatctgtacagaaacctgggttatcgatcacaaagatattatccaggatctgcagcgtgcctatattcaggcaggaagtcaggtaatctatgctcctacttttggcggaaacagtataaatcttgagaaacacggactcagagataagattgaagagatcaaccgtactctggtcggctattctaaggagctggccggcagcggtatctatgtagccggtgatatcactacttccggatcttttatcacagctgatggggattatacttacacagaagcttataatatgtatcaggaacagatccgtattctggcagatgcaggtattgatctgattgcagccgaaacaatgatcaatattgaagaaactcttgcagctgtagatgccgccgcttctgtatgtgatcttccgatcatgtgtaccatgactgttgaagctgatggaagtatcttcagtggtggaaatgctgtggaagcagctgtttctcttgaagcagccggcgcagatgctgtaggtatcaactgctcagtgggacctgatcagctggtatctgttgttcgaaacattaaagaaaatgtttctattccagttatcgccaaaccaaatgccggtatgccggtcatcgatgaaaagggaaatgctgtgtacagcatgaatgcagaagaattcgcccatcatatgaaagtcctgattgaaaacggtgcttctgttgttggtggttgctgcggtaccactccttcattcatcaaagctttgcatgacacgatcagataagcgataatttttgtttgaactgatccagtttgtaaattttgatcggacacaacttataaacaaacaatctaaaggagcttttgcaaaacagacacatattcatctataatgcagaagctccttttccatgcaacaatttaaggcatgattgaatttccggcctaatcatttcacctggattgctttttcggggcacatctcctggcagcagaaacaacggatacatttcttataatcatatactggtggattctctctgcctttacggaaatcaacggccttgtccggaaccggacagctcttcacacaaatcccacaccggatacaacgctccggctcaatataaggcttcttctgaaaaatattcaaggctttcgcaagacgttcccacataccggaacgtaccactctccggtccacatcaaaatacggatttccatactgtgctactgcatccttcattgaaatctcaccggacggagtaacaatttcaatttcttccgaacgccaggtaccaagtcccattttttctccatgataattcgttggaaccatctccggattcagatggatcaggttacagaacacactatcaagtgcaaccggatcccgtgacatcagcatcacattcattggagcaggatctccggaacctggtccgttcccctccatggccacaattccatccataatatacagacgcggcttcacatactgattcagatcgacaagcatacgggcaaaactgtctgcacttgggtacaatgtatgacctttggctttgtgaaatccataaacgaatccatagctgtttttcacagctcccgtgatgcgttccagtgcatgcgtcttcattttgcaaagagagatcacacagtctttttccagaagttctttcggcaaaataaattcttttgcctgtattcctttcggatagtctacatggattcccgtcgtataatcaatagccggaatatccagtttctcaagatacgtatccattcctgtcccatggatcactttagaagttgttccatttccgcaggaatctgcaagtgccatatcctgatatcctttttctctcatcagtcgggcaaacattcccacaaccgtcggatgtgtgatcactgccttatcaacttccgctttctttagaagattcggcttcagcaatacagactcttctttaccgacaatattctcgattccgcccagaagctccagtccgatttcaagattctcataaacaatttcttccctgtaagaattacagggaagaagaatgactttactttttttattcattataatcctcatttaacagcagaaactttctctccgccaagatctgtctcacgaattgcttttcgtaccggaagtacacacgccggaacaacagacagaaaatcaacccccatctccagaaattttttcgtcagtgctgtgtccgctgcgatttctccgcagatgccaaccttacggccttcctgatgtgccgcatccacaaccatacgcaccatacgaagaattgccggatgatgatcgttgtatttgtctttcagaagaggattctgacgatccatcgcaagcgtatactgtgtcaggtcattggttccaatacttaagaaatcaacatgttttgcaagttcccggctgatcatgactgctgccggtgtctcgatcatgattcctgtcatgatctctttaaatggaatgtttttttcgcgcagtccttcttttacttcctcaatgatctgccatatctcatccatttcttcttcagaatcgatcatcgggaacatcattgcgagattaccatacgcactggcacgataaattgcacgaagttgtgctttaaacattcttcttcggtcaagacagagacgaatcccacggttgcccatgataggattggtttcctgcggaatgtccagatacggagcctgcttgtctgctccgagatccgcagtacggatcaccgcaagtctctcgcccattgtctctgctacttttttatatgcacggaaaagttcattttctctcggataattttctcttccaagatactggaactcacttcgcagaagcccaattcccttggcgccataaaaaaggacactgctcagatcactcatatttccaatattggcataaagaccaatattgctgccatcctttgtttcatctttctgcgccttcagtttcagaagttcctctctctctcttcgatccgcttccagacgaatctcatattctttctggatttccgcatccgggttaagataaaaagttcctgtataaccatctacgattgctgtctttccatcccactcatcatcagctgcaacatcgaccaaagttggaatttccattgttttcgccataattgatgcatgagatactgctgaaccatgatgcatgaccacagccagaagtttatccttgtccatttccataatctcagtcggcgacaatgcctccgcaaccaggatcacaggttcgtccccaagattaatacggatggctgcaccacccagtatctggatcagacggttggaaatctcctgcatatcattgattcttcttcgaatgaccggctcttccagatgtcggaatgtctcaaccagttcatctctgttgatcataactgcataagcagcatttaccttttcattggcaatgctgctttcaattgcattctggtaactttcggattccagaagtttaatctggcgaagaaaaacaccggcctcctgttcattcagaagcctgttggcttcatacagctcatgaagtttctgaaccgcctgaagccgggcttcctgaaaattaccaatttcttttttgatgttgctgaccagacactgacgtatctggtattcccctctgctgtaatacagtatcttgccgatggctattcctgaaaaggtagcagtacctttatagatttccatcctgcttcccccttattttatcagtcgcaggcagctttgaactctgtccagttcttattgtaagcttcttctgcttctgcgctgatattttctactgctgatccctctgttacggaatccggtactacaaggtcctgattctcaagcagggaatctgctgctttgtttgtgctgtagtatccgatataatcgaaacattttgctgcattttccggctgaagaatgtaatccatgaactgatatgcctcatccttgtccggtgcctggctcggaatgaacattcccattacaccaaatccaagaccttcttccggatatacgactttgaggtccggattttcctgaagggcggctgttacctgtgaagtgtacaggaatgcaacacttgcctctccgttcagaagagaatcctgtgtattgtcatcctgaatcagacgaacattcggtgcaagctccagaagtttctcacctgttttagcgatatcatctgtatcctgatcattgaaatcctgaccaagtacaaggtttgtgataccattgataacacgatagtttgcagtcagtgcaatgctatcttcaagtgacggatcccagagatcattatatcccttgatatcaatatctaccatatccggatcatatacgatcagcggaatacctgctccatatggtgcagtatattcatcgttcggatcatagaactgtccctgatacagcgggttgatgttatcccatccggataatttggatgtatcaagtttttctacaagaccttcctggattgcagtttcgataatataatcatctgcaacaacaacgtcgtagtctccaccttttgccatggaaagcttttccaacatgttttcatcagtgtcgaaattggaatataccacttttattccagtttcttcttcaaagccatccagtacttcctgtggaaacatgttctcccatgtataaagtacaagttctttggaatctgcacttacagatacgctcatagccggaatgaccattgctgcacataatgcgcatactactaattttttcatagccttctctcctcttgtcttttattataaactcttcatgaagcctatgaatttaagtatagcctactttgacttcattgaaaagagtttattcattgtttttgctatttttgacttttctggtcctgattatttagttctatgttttgtcagctttccgatcaggttataaaccagaaggatcaacagcgtaaacaccagcatgatcgtgcagagagcattgacctccggcgtaacaccggtcttgatctgggtatagaccttaatcggcaaagttgccagacgtggtccgttgataaagatactgatgacgacatcgtccatggacattgcaaacgccagaagggatccggacaacaccgccggcatgatcagcggtaagatgatgtcccagaatgcccggaagggaccggctccgaggtctctcgctgcttcctcaagcgacggatccatgcccgccagtcgtgccttgacttccatcagtatatatggcacacagaaaacggtatgaccgatcagtaatgtcagcataccaaatggcagattcatcatatagaaaaatgccatcagtaccataccaaggatgatctcagggatcatcagcggtaaaatagaaatatattccagaatcccttttgtcttccagtggatcctggaaagtcctactgcacccagggtgccgatcacagcagataccaggcagctcaccacacccagaaaaaggctgtttcccagcgcttccagcatggcatcatcatgaatcagctcctgataccatttcagtgaaaatcctgtaaatcgaacaggaagttttgattcattaaatgaaaatacgataactaccgcaatcggcagatacatcagtacaaaaatcagtccaagataaaacccggagagctttgaattcttttttttcatcccacaccctccaattcttttgcatttgttacttttcgatacagcatgatcatcagtgttgtaaggatcatcagaacaactgccagcgccgctgcaaacggccagttgtttccttttgtcatctgttcctggatcaggcttccgacaagaacgatcttatttccaccaaggatatctgctatgaaaaacagtcccatagatggaacaaatgtcagaatcacaccggatagcagtcccggaagtgtcagtttaaaagaaaccgtccaaaaagctttcgccgggctcgcccccagatctctcgcagcttccaccagtgaccagtccaatttttctgcgctggaatatacagacaggatcataaatggaagaagcacataagtcataccgatcacgattgccggatagctgtacaagatacgcaaaggtttctcgatcagtccaaggctcttaagggcatgattcagaagcccctttgtctgtaaaatgatcatccagccatacagacgaatcaaggaattgacccagaacggcagcatcagaaagatcatagcacgttttttccactgttcagaaagcttcgccataaagtagccaaacggataaccgatcagacagataatgatcgtactggtcacagcaagctggaaagaaccggtgaatgttttcatatagaccggatcaagaatttttttataatttgcgagtgtaaatacccactccacaccatgacctgcttttggctgtgcaaagcttaatgccaccatataaagcagcgggcctgcaacaaaaatgatcgtaaagatatacaacggcaggatcatccagacagagccggatttatgtttcttcatactgccgccccgctttctgtctcagacggaagatcaaccagaaccgcattctcagcatcaaaatgacaggtgactttctgtcccggctgcacaccggcatcaattccatgtctgtttgcaataacttctgttccatctgcaagcttcaacacaacacgaagaagtccgcctgcaaaacttttttcaacaacaaccgcttccataccactctggcaagtctcatcaaaaatcatattctcactgcggacagccagcgtcactggtgtacccggagcaatttttttgccttctgccacagcagaaacaatactgcctgcaagtgaaactttgagaatatctgcttctgtttcctgcgcagtaccttttaaaatattggcatttccaacaaaagtcgccacataactggtttttggatgattatagatctcatccggtgtcccaatctgttcaaaggttcctttattcatgacagcaatacggtcggacatgttaattgcctcttcctggtcatgcgtaatataaataaaagtaattccaagctttttttgtaacctcttcagttcaagctgcatggcacggcgcagctgcagatccagtgctcccaacggctcatccagaagcagcaccttcggattattgaccagcgaacgggcaattgccacacgctgtctctgtccaccggaaagttctgacggctttctcttctcgtatcctggaagctgtaccagttccagcatctcagatactcgttttttaatctctgcttttggtatctttttcaatttcagtccatatccaatgttatccgccactgtcatatgtggaaataacgcataattctgaaatactgtatttacatcacgtgcttccggtgccagtgctgtgacatcttttccctccagatataccttgccggaatccggtgtctccagacctgctatgatacgcagagttgtcgtctttccacatcccgaggaacccagaagtgtaataaactcccccttgtcgatagagagactgatttccttcagaaccacttcatcttttgaaaacgacttcctgatatcttttaattccaaacatttttctgccatttgtcttttgtctttcctcctgctgttttattgtattcctgcattcagcaattccttacattttattctatcgtattcttcacatactgaatgtaactttccttattgaatactggtgtatagctttttgtaatcttttttgcttcctgtccgccattcttaagaagtttatatacagtcagtgccagaagcttcgccggtaaaatataggctttttccggatctgtgatcttgaaatctgccccatgaagttttccttcaaaacccttgaatgtaaaattcacaaccggaacaagatggctgagatctcctacatccgtgcaggcattattaaaatcacctttctgtactgtacgataattcagtccaagatcatccgccgcctcgatcagtgcgttgtctgctgctctcgggatgatcggcatataaccctgaagcttctccatttctatttttccaccaaaagcataggctgaaccggcatacgcacgatttaccatatctgtaatctcacaaatcttgtcaagcgatgctgcacgaaccttcgtctcaacaattgcctcgtccggcacactgttgatcacatcgccggccttccggatcacattatgaagtcgaacatgatcttcttcacggaaagtctcacgcatcagtcccatcatttgaattgcacttgtcgttatacttaaagcattgacaccattccatgggtcaatagctccatgtgcagcctttccccgcaccgtaacacgctccgcactgtagccattacaggccggattcccaagataaaaatcttcttcaacaggaaccatatgcacatgcgtcgttaatgcaatgtccgtatcgtcgaagacacctgtgcgaatcatctcgcttttaccgcaacagaactcaatgccttctttttttaatctggcacgtttgtctgcatcaatgtactcctctgcaggaactgcaagaaaattcacagttcccgcaagacatttctgcacatctggatctgccattgcgatcgcacatccgatcattgccgccatctgtgcatgatgaccgcaggcatgtgccacgcctgttaccggattcgcattgggatgggaatgacatccaatcgcatccagttctccgatcacagtcagggaaggaccttcttttatacttttcgttcccttcacaccggtacgggcaagatgttctgtcactttatatcctaaattcttcagaacttctgcagtcttcccggctgtacaaaattcttcatatccaggttccggatgcgctgcaatatcctcagcaaatgcaatgatctgatctttatgtacatcaatcagccgcaaaatacgctgtccggtttcatctatcataaaactcatctccctctgccacttctggatgttatctgcttcattcagacaacttgacagaatgacactttaacaagttaacgcgttatacaaatactatattcatattctcatatcataacataaatctcactcattgcaagtactgaaaataatgcaggggaaaacaaaatttttcttgcattttatcaaaaatacgctataatatattttgtgtctgaacacaagctgaaatagctcagttggtagagcacttcactcgtaatgaaggggtcgtgggttcgagtcccattttcagctttctttttttgcctaaaaatgccgccagattctattctgacggcatttctattatactgcaatatctttttttactgtttttctggaaacggtctttttttcaccagctttcttcgctactgttttctttacagctactttttctgcagcaaccttttttgcactttccttctttggtgctgtcttgcgggcggtctttttggcagttgtcggtttcttcgctgctactgccagtttctccggctttttgcccggtgtgcaggaaaaaacagccacacccagtgcaggaatcttaaaggtaacagaatattctctttcatcacagtctgcctgtttgcaggtttttgcccttacgtttactattccctgtccgccatattctttgcggtcactgttgaagatctctttgtattttccatagaatggaacacccatctgataattctcatatggaactgcagcaaaattacataccgcaagaagtgtttcttcaggattttctgttttgcgaaggaatgtcaggacattttcttcatatttcataagctggatccattcaaatccttcataatcattatccatgagtgacaatgccggctgagagacatacatctcattcagatcgtggataaatctcttcatttcatccgtaagctctttgtccggtgccatcatcttgcagcctggatgcagcatcatgtaggaatatgcagcccggatctggctcagtttctgtaactcatcacctggaagttttgccataaaactcttctgatcaccggtttctctgcttccaagcggaagaacaaagtgttcgcagtaagtgtacagcatagaaagtgtcagctgatcatgtacatactgacgctcgatcggatctttggaaaggtaattcagaaaatctcctgcccagttattgttccatttataagaaaatccaatattgtcatcctctacacttccagtcagttccgaccagagaccatcttcctgtgcgatcgtcattgtacccggaagcttctttgccaaaatagaattaagatgtttcagcaattctacagctgcaagattttcattggttccataaatatttggtctccactgtccatattctctgccaaagtcaagatacagcatagaatccacatcatccagtcttaaaccatctgcatgatagaattccagccagtaaaaagcatttgccagaagaaaatccttgaccatcggactttcaaaattgaataaaagagttccccacatcggatgaatagccattgatggatccggattttcatataaaggtgttccatcaaactgttctaatccaccctcagttcttggaaaatgcgaaggtgtccaatccaggatcacaccaatattttctttatgaagttcatttactaaattctgaaaatctgccggtgttccaaatctgcggtctggtgcataatatgcaaatgtactgtattctccagcttcatcatcaagatattccattaccggatgaagttccacatgtgtatatttcagatttttaagatatttaacaagctcggcagcatttttccatttggaaagactggtctcataaatagaaatcggctgtttacgatcgctgaatctttcacgatctttcatccaggcttcatcatcccatttaaacccacgaagatctgtaacaacagaggccgatgccggaggaacctccgtacaggcagcatatggatccgatttaagctgtaccgcaccgccttttagttttatttcatatttatagatttcaccggctttcacacctggaataaacaattcaaaaataccagacataggcatacgatgcatcatatggcagcgaccatcccagttattaaaattgcctactacgctgacacggagtgcatttggtgcccagactgcgaatgcagttccttccacaccattaatttccatcggatgagctccaagcttctcatatgcatgataaaaaacacctgcacagaaagctttttcttctgcctctgtgatctgtcccggaaatgcataaggatctgcaaaaatcctgatttcttctcctctggtaatgcgatactgatatgccgggatctttcttcccggaatcattgacgcaaagtaaccggcatcatcctgtttctccatctcatatgcctttttatctacaagaacttctgccttctctgcatccggaaaaaatccctggatcagaataccatctgcagtaagccgaggtgccatcagatctttcggcgatgcttcttctgcataaacaactgcttcaatctccggccagtccatatatttatatactttgctttccataattcatgcctccattctgaaatacaattctcaaattgcattcctttgttttagtttatcatttttttgtataaaaataaagaatataccgaaattagtttgacaaaaagagttctctacgataaattgaatatatcaaagaacatatgaaacaaggaggtctttattgatatggaaaaaagacaatttgatgtaacagctcttggcgagcttcttattgacttcactgaaaacggtttcagttcccagggcaaccctcttatggaagccaatccgggtggagccccatgtaatgttcttgccatgctggaacgtcttggaaaaaaaactgcttttatcggcaaagtcggcaaagatatgttcggaaatcagttaaaatcagcggttgaagaggtcggtatcgacacacgcaatctaattctggacgaaaaatatcataccactcttgcctttgttcatacatatccggatggtgaccgtgatttttctttctatcgagatccaggtgcagatatgatgctcactaaagacgaagttcaaaaggaactgattgaatcctcccgcatcttccatttcggaacactctcttctactcacgaaggtgtacgtgaagctacccgccatgcgatcgaacttgccaaagaagccggatgtatcattacctttgaccctaacctgcgtccacctctctggaaatccctggatgatgccagagctgagattgaatacggcatgtccaaatgtgatgttctcaaaatctccgataatgaagtagaattcatgtgtggtacaacagattatgataaaggtgctgctatgatccaggagaaatacaacattccgctcatccttatcacactgggtaaggatggaagccgtgcatactataaaaatatgcgagtagaagcagctccattccttcaggaaaatacaatagagactaccggtgccggagatactttctgtgcaagtactttaaattatgtacttgaccacggcctcaatgatctcacagaagaaaatctgaaagaacttcttacttttgcaaatgctgctgcatctctcattaccacacgaaagggtgcacttcgcgttatgccaacccgcgaagaagtcgaagcttttattgaaagccgcaaataatttttcaaaacttttctaactgaatatacaaaaggtcccggacgattttatctgaatcatccgggacttttttcgatttttatttgatcacgcgaaccttagatacaccttcaattgcttttaattcatcaagtgcttctttagatgctgcactttccagatcaatgatcgtatatgcatagcttccacgactcttatttgtcatatctgcaatattcagtccttcacttccaaggatcttggtaaactgactgatcatattcgggatgtttttgtgacagatggtaatacgtccaactgctatacatgttcccatgtcacagtttgggaagtttacagaatttttgatatttccgttttcaaggaaatctctgacttcttttacagccattactgcacagttttcttcagattccgctgtggatgcaccaagatgtggtgtaacgaggattcctggtcttccagccacaagcggatttgcaaagtctgttacatatttcttaaccttaccactgtcaagagcttcgatcaaagcttcttcatcaacaagaaggtctcttgcaaagttcagaagaacgacaccctctttcatctttgtgaaagcttctttgtcgatcatcttacgcgtattatctgtcagcggtacatggatcgtgatataatcacactggctgtagatttcatccagagatttgctgtgtttgatggttcttgacagattccacgctgcatcgatggaaataaacgggtcatatccgtaaacttccatgccaagatgtgttgcagaatttgcaaccatagctccaatcgcaccaagaccgatgataccaagtttctttccactgatctcacatccggcaaactgctttttctgtttttcagccagtttgtcgatatgttctttgtcctcttcatgagcaacccattcgatacctccaacgatatcacgggaagccagaagcatgccggcaagaacaagctctttcacaccatttgcattggcacctggagtattaaataccacgataccattttctgcacactgctcaaccggaatattattaacacctgcacctgcacgggcaataaccttaacgttctcaggaagctccatatcatgcatctttgcacttcttaccagaactgcatcagcatcatttaattcttctgtctgtttgtactcctcaccaaacaggccaaggcctgtctgggatatagggttgaggcatttatactggaacattatacattttcctcctcgaattttttcatgaatgcaacaagggcttctacgccttcttttggcattgcattgtagatacttgcacgcataccgcctacagttctgtgtcctttaaggtttacaagacctgctgcttttgcttcttttacaaatttggcatccatatccttgtcacctgtaacaaaaggaacattcataagagaacgggaatttggctctacagtacctttgaagagtttgctctgatccagataatcataaaggatctttgctttctcgatgtttctcttctgcatttcttccagtccgcccatcgctttgagccatttgaaaactttgccgcatacataaatgcagtaagcattcggagtattgtagagagatcctgcatctgcatgtgttttgtatgtaagcatggttggtgttcccggaagaacatcctctgtaataagatcctcacgaatgattgcaataaccatgcctgcaggtccgatatttttctgaacaccgccgtagataatgccatatttacttacatctacaggctcagataagaaacaggaggaaacatctgctaccagagttttgccttttgtattcggaagtgttttgaattttgttccgtaaattgtattattttcacaaatgtatacataatctgcatccgggctgatcggaaggtcgctgcaatccggaatataagagaaagttttgtcctcagaagatgcaatcttatttacctttccatacttctgtgcttcctgatatgctttttttgcccactgaccggtaacaatatagtcagcaactctgtttttcatcaggttcattggaatcatggcaaactgctgagaagcaccgccctgaaggaataataccttgtaattgtccggtatcttcatcagatctctgagatcctgctctgcatcatcaatgatcttctgaaactccgggcttctgtggctcatctccatgacggacattccagttccctggtaatccatcatctcgtctgctacttctttcagcacaggttccggcagtacagccggtcctgcagaaaaattatacactctgctcattgttcttcatatcctcctcatcaaaaacttcattcagacttgcgcctgcaggtaccataggaaatacactgagatcctggtcgatccagcaatccagtactacaggttcgtccatagccagtgccttacggatcgccggctctacttcttccatcttcgtgacacggaatgctttcgctcccatgccctcagatattttcacaaaatccacggcatcgtcaagaacggtgtgtgaatatctgtggtcatagaataaggtctgccactgacgtaccatacccagcacatgattgttcataacaatctgtaaaagctgtttatggcaacgtactgctgtcgcgatttcattcatgttcattctgaaacagccatcgccggcaatgttgacaactgttttgtccggtctccccatctttgcaccaatcgcagctccaagtccgtatcccattgttccgagaccaccggaagtcaggaatgtacgtggttctttgtacttgaagtactgcgctgaccacatctgatgctgaccgacatctgttgaaataattgcgtcacctttggtgatttcatagagtttctctataatatatggtccggtaagctgggaatgatcataagtcagaggatattttgctttcatctcctgaatatgttcgatccattccggatgctgttcttccgggatcatttcaagaagtctgcgaagaacttctcttacatctccgattactgacgcatctaccaaaacattcttattaatttcggccgcatccacatcaatctgcaggatctttgcctgtttcgcaaatgtctttgcatttcctgtaacacggtcgctgaagcgtgcacccaatacgatcaacaggtcacactgagttacaccaaggtcggaagtctttgttccatgcataccaagcattccggtatacaatggatcttcccctgaaaaagcaccttttcccataagactgtcgcaaaccggtgcctggatcttatgtgccagctcactgatttctttggaagcaccggaaataacagaaccaccaccgacgaaaatatatggtttctttgcttcttcgatcatctgtgcagcagtttcaagatcttccttacgaatcgtttcaacttcacgattgatcgtagccggacggcgtacggaatattcataagtagctgctgtcacatcttttgtcacatcaaccagtaccggacccggacgtccgctcttggcaatgtaaaatgccttgcggagtgtgtctgccagcattgtgatgtcttttacaataaagctgtgttttgtaatcggcataacgattcctgcaatatctacttcctggaaagaatctcttccaagaagtggtttgccaacattcgccgtgattgccacaaccggaacggaatccatataagctgtagcaatacctgtaaccagattcgtagccccaggtcctgaagttgccaggcataccccgacttttccagtagcacgggcataaccgtctgccgcatgagaagcaccctgttcatgagatgtcagaatatgctgaatctcatcactatgtttatagagagcatcataaacgttaaggattgccccacccggatagccaaaaacagtatctaccttctgttctttcaggcattcaatgatgatctctgcacctgtaagctgcatcgtatttcctcctaatgtttatcaaataatcgcttttctcttattttgcttttggcacttcaaggattgctcctctgttgcctgaggtaaccattgcagcatatcttgcaagatatccggttgtgatctttggttcacgcggctgccattttgcttttcttgctgccatctcttcatcagaaactttgacttccagtttcagttccggaatattgatactgatgatatctccttcttcgatcagggcaatcgggccacctacagctgcttctggtgagacatgtccaatagaggcacctctggatgcaccactgaaacgtccgtctgtgatcagagcaaccgatgaaccaagtcccataccagcaattgcagaagtaggattcagcatctctctcattcccgggccgccttttggtccttcataacggataacaaccacatctccggctacgatcttaccacctttgatagctttgatcgcatcgtcttcgctgtcaaacactctcgcaggtccctcatgaaccatcatttcttctacaactgcggaacgttttacaacgccaccatctggtgcgatatttcctttcagtactgcaagtccacctgtctgactgtatggattgtcgattggacggataacttccggattgagatttacacagtttttaatattttcgcctactgtttttcctgttacagtcatgcattctatatgaagaaggcccttcttattcagttcattcattactgcataaacaccgcctgcttcattcaggtcttccatatatgtcgggcctgccggtgcaagatgacagagattcggggttttttcactgatctcatttgcaaagctgatatcaaaatccattcccacttcatgcgcaattgccggaagatgaagcatactgttggtagagcatccaagtgccatatctacagtcagtgcattcaggattgcttcttttgtcataatatctctcggacggatgtttctgcggtacatttccataacctgcatacctgcatgttttgcaagacggatacgttcggaatataccgccggaatggttccgtttccacgaagtcccataccgagaacctcagtcaggcagttcatggagtttgcagtgtacataccggaacaggatccacatgtaggacatgttttgttctcaaattctgtcagttcttcttctgaaatcttgcctgctgcataggatccgacagcttcaaacatactggaaagacttgtcttgtgtccatggatatgacctgccatcattggaccgccacttacaaatacagtaggaacattgattctggcagctgccatcagaagtccaggtacgtttttgtcacagttcggaaccatgaccagtgcatcaaactgatgtgccattgccattgcttctgtagaatctgcgatcagatctcttgttaccagagaatatttcattccgacatgtcccattgcaataccgtcacaaacagcgattgccgggaatacgattggtgtaccaccagccattgcaacaccctgttttacagctgctacgaccttgtccagattcatatgtccaggtacgatctcattataagaacttacgattccgactaacggacgttccatttcttcttttgttaatccaagggcattaaacagggaacgatgaggtgcctgttgtgagcctgtttttactgcgtcacttctcattttcttatctcctctttacttaatctgtacgatacttacggattgttctgtacaaagcaattatactgctgctgcgatcagatcccccatttcttttgttccgacttttttgcagccttcagacataatatcaccggtgcggtatccgtctgtcagtaccttctgtacggctgcttctactgcatctgcttcttcatcaagattcagagaataacgaagcagcattgctgctgaaaggattgttgcgatcgggtttgctttattctgtcctgcgatgtccggtgcagatccatgacttggctcatacagaccgaatttcgtctcgttaagacttgcagaagaaagcattccgatagaacctgttaccatacttgcttcatcagacaaaatatcaccgaacatattctctgtcaggataacatcaaactgtgccggatcatgcaccagctgcattgcacagttatcaaccagcatatgctccagtgtgacttccggatagtcctttgcaacttcttctacaacttttctccagagtctggaagaatccagaacgtttgctttgtctacacttgtgactttttttcttctcttcattgcaatgtcaaaagctttgattgcaatacggcgaatttcattttcattataggaaagtgtatcgattgctttctttactccgttttcttcgattgtttttctttctccaaagtaaagaccaccagtcagttcacgaacaatgatcatgtcaaatccgttctctccgatcacttctttcttgatcgggcatgcttcttccagttccttataaagatatgccggacgaaggtttgcaaagagatttaatgccttacgaatcgcaagaagtcctgcctccggacgtttggatggttccagtttgtaccatggagatgtctttgcgtcacctccgatggagcccatcagaactgcatctgaagcttttgcagtggcaattgcctcatctgtgagcgggacaccgtgaacgtcgatagaagctccaccgaggagcacctctgaataagtaaatgtatgatgatatttttcacatactttatcaagaaccttttttgcttcactgacgatttccggtccaattccatctcccggaatcaatgcgatcttgtattccatttcttcatttcctctctctgcatcacacgaaacttaagcagagtcctttcgttgcgaatattgttattataataacgcacttttttatacttttcaaccctttactacgtaaaagttagaacgtattgatataagattgatataagcacatttccttaaataaaatcttcaaaaaaaagaagtgctgcatctgacgcagcacttactttcttatttgcagttatgcggatgcctgctctgccttctccacttctgcaatagcctgttttctcattgggatacggcagttcttgttattgccgaattctacgatcacatcttcttcagtcatgtcgatgatcactccatagaagccacctgtggtaacaatgctgtcaccgacttccatgctgttgagcattgcctgaagtctcttctgctctttcttctgcggacggatcatcaggaagtacataactccaaagattacaaccatccataaaatcatcatacccatgcttgcggtactttcgttcatttaagattcctcctgtttactgacttacattccctttttcaggaacactatacattatcatacacaaaaatgcctgttacttcaagtgtttttcagcattttgtattatttctgtctataattcagagactgttgtattatttctactctccggctgcaaatccttccagacgcatctttttgtaatctgcaaatctgccttcatccagtgcatcacgaatctcttccatcatatgattgtagaaatacagattgtgcagaacacagagacgcattccaagcatttctttcgctttgagaagatgacggatataagctctgctgtaatgacggcatgccggacagccacaaccttcttcgatcggacgtgtatccagttcatatttcgcattaaacatgttcattttgccatgattggtgtatacatgtccatgacgtccgttgcggcttggatatacacagtcaaaaaagtcaataccacgttctacaccctcaaggatattggccggtgttccgactcccatgagataggttggtttgtcctgtggaagatacggtacaactgcatcaagaatacggtacatttcctcatgtgtctcaccgactgccaatccgccaactgcataaccgtcgagatccatttttgcgatttcttttgcatgtccgatacggatatcctcgtaaacagccccctggttgatgccaaacaaaagctgttctttattgatggtatccggcaagctgttaagacgggccatctctgttttacatcttgccagccagcgtgtggtacgctctacggatttctgtacataatctctgtctgccacgctgctcgggcactcatcaaatgccatagctatggtagaaccgagattggactgaatctgcatgctttcttccggtcccataaaaatcttgtgtccatcaatatgtgactggaaatggacaccttcttctttgatcttgcggagtttcgcaagggaaaagacctggaatccgccggagtctgtcagaatcggacgctcccaattcataaatttgtgaagtccgccaagctgcttcactactttgtcacctggacgcacatgcaaatgatatgtattagacagttccacctgtgttccaatatcataaaggtcctgtgtggaaacagcaccttttattgcaccgatcgttcctacgttcatgaatacaggagtctggatcgtaccgtgtacagtctcaaactgtgcgcgcttcgctcggccctctgttttcattaatgtatattttgccatgattattcctctttctgtttgatttgcatttagttctaagtataccagacagaaagaaaatggtaaagtcctgttatataaaaatgatatttactttatcatttccatccaggacaaaaaagcggtattttcagcagcgatccttgtattatatgcaataacattctgattatcgactacagatttcatatttccaacaaggccatttatcgtgttattcatgttgttaactactacatctgcgttttcaatcgcatcatataatgcatactgtctatctcgaatttcatcaagcctatatatcacatcatcaagtttcgctattataatattcattctgatttctgtttcatatatgttatatgcaccctcatgacctgttaacgtatcacatcttccagaattgaaatattcgtaaaaagccgcaatcggaaccaatccccggtatttgggataaatgatatttttgctataaaaattatttaaaatttgctgagtctctttttgattatcacaaacaatcaagtattcctttcttacctcgtctatttgttttctaattttttcaacccgctttgcattctcacgaacaacacgatcattatgttttgtcacttgtttgtttttatcatctgcatcccatgccttcatttgttcaacaagtagccccaagattacccctattaatgcacctattaaatttgctgataatagcggaccaaaaaaacccttaacactaaatcttgtaaaaattcctaagcaaacaagtacgattgctcctgttacagctccgaacatagccattccgataatagtttcagaatctatcgatgctgatacataattctctaatggtaattctctcttcttatctctctccaattccagacaacgctgcgataaacaatttatcatttttccttgctcataattgattctttctaaataatatacttttttaagaatctccttcatattttttcctgtgttatccatacccaatctcctaataatatattattgcacttcgttttctcttgttttaattacatctgcattttttaattcatactgattgagtatctgttccatattctcatcaaaagaatccgcatcatattgcggtgagtaccatgattttgtattaaaatattcttgtaattgtgcatctttaaattttcttccatggcgtgcaaatatttcgtttcttgcaagtcttaactgttctgaagacatccctcccaattcgttttctgatatgtaacggctatcgctgtctggtaatatatattcggtggtattttcagttgaaatatttgtatcttgcgtggttgtattagtctcttcctgattattttctccattttgaatgtttgtgtctgcagaactttcttctatatattcagttgtatcctgtccatcccaatcactttcggaagtcgcatatttttctatataatgataaacatttgcgtcctcatcactatatgcccttcccagagacagccatccatcacgaaacgcttcatcaagttcatattctattgataataccttttcaccttttaaattgacgcagattgtctcctcctcatttggaactgtcataatgccatcatctgaaagtaaatcacctatatattcttcatacaccgcatcattatcataactagatggggtatccattattccaacattacatgctatcggctcaaaacacatttgtccctgattatcaagaatcgttatataattttcctctgataccgttcccttcagcaaacaaactgaatatccatcatctcgcggtgagatattcataacaattatttcttctgtatctgcatttgagaatatgacatttccattaagatcatataacgtagcttttccagcatacgctgtcgcaacatgatctgtacttataaattttgcacctaaaatcctgtcaaaattagtcttcactgcaaattccgaaactttatttcccacagaatcatagactctcaaattccaaccatcatctccggccagcaaatattttgcatgatccgcttctccaaaccattctaaaccatgtggaaaatctggactgataatctgtcctgtctctacattataaaaacctccatcacatctgaataacgaaccatagcttctccatccagacatactattttcaaattcattgattgccaacggcaactcagtttctgtgcctttcataagaatttttccattataattaaataatccatattcattttctttatgttgatatccgctcttattataaattgaaaatatataatatccgtctttagaatacgtgattgaatcattctccgataactttatgtaatgttgaccatcacgaagcaaaagaagatcagaacctatcaaacaatttccaagatcatcccatgtaaaccattgattttgttccgtatcacatccaaacatttccgtcagattacatctgagttccagcttgtcattaatatatcccaaaaataactcctcatctccagactcttcatctgcttcctcatcacttctttctttcatcattacaactgcatgtccattatgaaacgttccactttccacaatttcatactcacattcttcatctgtatttatttcaaatgttgtctgaagtatattgtctccaacattatattgcgacaaatcggtttcatatgtttcagcataaacattgttcgattttgccattagcaacattatcccaaacaacataaccatccaaatttttttcatacacataagcctccttgacaatttttattcttttgttccaaccatttcctgatcatcatcttctaatgtcagctcatccccatttatttcatatgtatacatagcagtatttgtgctcctgattcccgataccatctgcgatgtcaaacaaatcttatcatctgcaaatgaatacactcctgttattattcgaccatcatcatccaaaaaagttccatcatccataaatgttatcgtaaacccctcatcaaattcccatgtccctatgatttgtttctttggatccgactgacaccctcccacaaacatactgattgcacagataacagctaaaacttttgtcttcttcattcctttccctcctgtttttatttaaatgagattttattgatatttcattcagatagtgcacagcccgatacatatggcaattgttttatatactgtgcaagtgcttcaccatctgtattttctttcagatacacaataaaataactataatcgtctgaaagaggattttccgtatctgctgaattcgagccttgaaaataatcatttataaactcctgccaggcttcttcgtttcctgcttgttcaatatgagcaactgccggttccttttctattgcattctttatctgttccagatttttctgagaagcttcttcagaaaaataaacttttatagttctttctgactcctgcacttcatccgaataattatccatttctggctctatatctgtattttcttctgctgattctgtttcttttatcgagtcttctgtcagtgcagcaacttcctcatccatttcatcatttgtatccatatcgttctctttttcaactgtcacattatattttacaggaatctcctttaaatcatcattattctcttctatctttatctgttcccattcttcctgcgaacctgtgtatgatatatattttaattgtttgcaatctttaaaaacatcttcaccaatatattccacacttgatggaattaagatttcttcgagtgccgtgcaattgtcaaatgcaccgctaccaaggtatatcaaattttccggcaattcgatttgcctgagcttatagcaatcattaaacgcttcatcgccaatactttgtatgctcctcggaaaatctatgtcccatatatccatacatttatcgaaagcattatttccaatcgtaactacaccttccgataaacgaacccattttaacttttcacatccactcaatgcattttccccaatgctacttacaccttctcccgtagcaaaatccagaatatacttttttcctgacttccacggaacagttccttctgaataatcatccatttgtccgcttccaccgattgccagggttattccaaatgccccgtcatatagttgccattccagattttctccatactcccctgttgtattgattttctgcaaaatatcctcttcacttagtttttctttaccacacccgcaaattaacagcatacttccaaataaaactattactttccatattctctttatcatattgtcttccctccttttctacttaattcattatacgtttttataattcgcatgtaaaatcgtatctccatcttgtagtctgtttatcgagtgttttttttggaatactatgagaacaaagaaatggaggtgactatgacaatagactatactgaaataggtaagcgaattgccaggcgacgtaaagcattaggtttaaagcaatctgaggttgaagaaaaagctggtcttggtcagaaatatctctctaatattgaacgtagcatttccattccctctatagaagtcatcatgaaattagcttatgtcttaaacacaactcccgatgagtttctaataggtactttaaattcaaatgatgaagaatggaagaaaagcgccgaattacttcgtccgctcaattctaagcaattaaacttggtacataattttttaatatggttatcagaacaagatatgtaagacaaaatctccccatctgtaattcgatggagagatttttattacttatttttttattacttatcatttactattttttatcttatattctgcattgtattgacatatcaatatattacaaatatactgtatatatattataaagaaaggtggttcttttatatggccaatatctctatccgtatggaagataaattaaaacaacaggccgaagaacttttctccgacctcggaatgaatctcaccactgctatcacgatttttgtaaagcagtctatacgtgaacaacgaattccttttgaaattacgcgtgaaactttaaatcgtgaaactcttgcagcattacgggaagtagaaaaaatgaaaaggaatccttcccttggcaaatcatttgatgatgttgatacaatgatggaggacttactgaaatgaaatattcaattaaaccaacctccaaattccaaaaagatctaaaacgtatccaaaaaagaggttatgatctatcacttctatccgatgtcatcaaaaagctatctaacggtgagtcccttccactaaagtaccgagatcataacctcatcggtaacttttgtggatgtcgagaatgtcatattactccggattggcttctcatctacgaaatctacgaaaaagacctttatctctatctaaccagaactggttcccacagtgatctcttctccaaataaaatcccctgttattttgttccatgattcacgcaaaaaaggcaaggtatacgcctcttatgcataccttgcctttttatacatttttcatccccaacatctatccccacaccaaagccgcgtggccaagaagggggagtccgagggggaacttcggccttcgcagactgtgagatacttccccctcggggttttcatatttcccaaatatcaaaaaacaaaaatttaaccccaaaaagttctatgctttttcaaaagcatgggctatcagggcagttccctgttgagattcttctgtgccgttgacagcatcagcttaattctgttcagctggtttacttcacttgctccaggatcataatcgattgccacgatattggcttccggatgttctctgcggattgctttgataacacccttacctacaatatggttcggcagacacgcaaacggctgaatacatacaatattcggtacgccgccatggatcagttccatcatctcaccggtcaggaaccatccctcaccagtctgattacccggagatacgatcggtgatgccatctttgccagatcggcaacattagcagccggtgtaaagtgacggctctgtgcaagagcttcgttcgccggtccacgcagccattcaatcgctttgattccccagtttgcgatcgttgctttatttttcttaaatccaaggaattcacatttgaagttctggttatagaaacagtaattgataaagtcgatcagatccgggcagactgcctcagcgccttctgcttccagaagttctgccagatgattgtttgcagccggaaggaatttgacaaggatttctccaacgataccaactcgcggtttcttttcatcgctgatcggaatcaggtcaaattcatgtaccatctcacgacacatcttcttaaactgtccatggctgacactgctgccttccaggaatgagattactctctgttcccagatcttgtgtttgcgattgacgattcccggctccagttcatatgggcgcatacggtatacgcacttcatcagaatatcaccaaacactgcaccatagcagacacgtttgatcagtggaagtgtcagtttgaatcccggattgctctccagcccacttaagttaatggaaataaccggcacctgctccatgcctgctttcttgagggcacggcggataaatgcaatatagttggatgcgcgacagccaccgcctgtctgagacataataacggccgtcttattaaggtcatatttaccggaaagaagagcatccataacctgtccgactaccatcagagacggatagcatgcatcattatttacatatttcaggccaacatcaacagcatgcttattatcattcggaagaacttccagatgataaccacaggtattaaaggctgcctgtaaaattccaaaatgaaacggtgacatctgtgggcacaggatcgtataatccttacgcatctgctttgtaaatacaaccttttcaatagaagacggtttgatctcacgctccttgtgctgcgcctcttttgcacgaagtgcagcgatcagagaacgcacacggattcttgccgcaccaaggttgtttacctcatcaatcttgaggcaggtataaatctttccgctgccatccaggatctcataaacctcatctgtcgtaacggcatccagaccacatccaaaggaattcagctggatcagatccagattatcctgtgtttttacaaagttcgctgccgcatacagacgcgaatgatacatccactggtcattaacacgaatcggtctctctacctttgcaagatgagacacagaatcctctgttaataccgcaattccatagctgttgatcagatccggaatgccatgatgaatttccggatcaatatgatacggacgaccggcaagaacgattcctctacgtcccgtctctttcaggtaccgaagggtttcttctcccttcttctgcacatccttacgcacctgtgcaagttcttcccatgctgcatgtgccgctgctttgacctcttctgccggaatatccttaaacacttcaaccaggcgatccgtcagaattgcttctgtcgtaaatgccataaacggattcataaatttaatgctcggatctttcagttcatccacattgttcttgatattttctgcataggatgtaacgatcgggcagttgtaatgatttactgcatctggaaattcattacgctcatatggcacacatggatagaaaataaacttcacaccttttttgatcagccagcttatatgaccatgtgccagttttgccggataacattctgattcactcgggatagattcaatacccagttcatatatctttctggtagaagtcggtgaaagtaccacttcgtatttcagtttcgtaaagaatgtataccagaacggatagttttcaaacatattcaggactcgtggaattcccacctgtcctcttgttgcctgatccgggcttaacggttcataagaaaacagtctcttatatttatattcataaaggttcggaacatgatccttgttcttctctttaccaattcctcgctcacaacgattaccactgacaaactgacgtcctccggtaaacttgttgatcgtcaaacgacagttattggtacatccacggcaattcgccatagaagttgtatatttcagttcattgatcttgtcaatagagagcatggttgtttctttgccgtcttcataacgctcgcgcgcgatcaatgctgcaccaaatgcacccatgatgccggcgatatccggacggattgcttcacagttggcaatacgttcaaagcttcgaaggactgcatcattatagaaggtaccaccctgtacaacgatatgcttaccaagttctgtcgcatctgaaactttgataactttgtaaagagcattcttaataaccgaatatgcaagacctgcagaaatatcagacacctctgctccttccttctgtgcctgttttaccttggagttcataaataccgtacaacgggttccaagatcgatcggatgttttgcataaagcgcagcttttgcaaaatcctgtacactgtaattcagagatttggcaaatgtttcaataaaagatccacaaccggaagaacaagcttcattcagctgtacactgtcaaccgtctggttcttgatcttgatacatttcatatcctgaccaccaatatccagaatacagtcaacttccggatcaaagaatgctgctgcataataatgagaaaccgtctcaacttctccctcgtccagaagaagtgctgctttgatcagtgcctcgccataaccggtagaacatgcataagcaattctggcatcttttggaagttttgaataaatctcctgaattgagcggattgctgttttcagtgggcttccgttattattactgtagaaagaatacagaagacttccatcctcgcctaccagggctgtcttagtcgtagtggaacctgcatcgataccgagataacagttccccttataagaagcaagatcacctgtagcaactttataagatgactggcgtttattaaactcctcatagtcctcttctgttgcaaacaacggatccatacgctctacttcgaaatccattttaatggaatgacggagtctgtctttcagttctgtcagcgaaacagtaacatcttcctttgcattcagtgcagaaccgattgctgcgaacagatgagaattctctggtacgatcgtatgttcatcatccagcttcagtgtacggatgaatgctttctttaattcagaaaggaaatgcagcggaccaccaaggaatgctacatgtccacggatcggcttaccacatgccagtccggagattgtctgattgacaaccgcctggaaaatagatgctgacaggtcttccttcgttgcaccctcgttgatcagcggctggatatctgtcttcgcaaacacaccacaacgggcagcgatcggataaagagctttataattctttgcatattcattcaggccaggtgcatccgtctgaagcagggatgccatctggtcaataaaggaacctgtaccgccggcacagataccgttcattcgctgttcaatattaccgccttcaaaataaatgatcttggcatcttctccgccaagctcaatcgcaacatctgtctgtggtgccatcttctgaagagatgttgataccgcaataacttcctgtacaaatggaatctccagatgattggcaagtgtcagtccaccggaaccagtgattaccggacttaatttcatttcgcccagctggttttgtgctttttccagaagatctgccagtgtctcctgaatatttgcaaaatgacgttcataatctgcaaacaaaagattttcattttcatcaagaatcgcgatctttaccgtagtagatccgatgtcaattcccaatgtatatgtatccaataaatcgacctcctcgtcaaaactgtatatatacagatatgaatataacgtgttctttcttattaaaagtatttctccaaaatcgaattccgtaacattatacgacaaagttttacaaatgacaatgaccaagtttcacaatttgtcgcatattcatttcccaaattaatttgagtgtcaaattttataacaaaaaaggatatctgttgaaatacccaacagatatcctgtattttccgtattttatcatttgaaaaacttgttttcccttatcttctgatcctctgtgcgattcgaacaagatatgccccgccaggcattctggaaagccgctcggatgctgtcttatcaatcaggatataaaccaggaaatacgctgctgctgccagaatgatcgatacacccaggcagatgatattagatggtaagattgcatgaaagccataataaacaccagctgccacgacacccatcactgcagaagcgatcagcggacttacgtaagccgccttccatgggttcttatattccagatattttttcataaagaaatcattcatcacgcatacaacgattgcatacacgatcatagcaaccagcaatgcataaatacccaggtctgtgaacatcagaagcgcaacaactacaatcacatctacaaccagcgcaactgctgctgtgatcatagggatcttcggtttaccaattccctgaagtactccattggaaatgttggacattccattcagaagtatcgtaaaggatccaagcatcaaaagctttccggccacaccatttgttcctccaaacagcagtgatacgattggctgtgcaagcactgccagtcctaccgcgcatggaatagaaatgaacatggacaactgcacggtctggtccactcttctccttgtttcatcaatatctcccgttgcatacagtgcagatacctccgggatcatcgaagtcggtgctgcacttgaaagcgtcaaaggaatattgataatactcataaagtaggtcgcatattctgcatacatcatactgatcatatctgcatttacaccatgttttcccatgatctcagaatacagaactccattcagataaccattaatattatagataaatgagctcaggatgattggagaaacaatcagaataatcagcttcagaatctcgccataagactcctcatcatgataatgatcatgtctgactctgcatttgatcgcattccgattaacaccatataccagaagcataaacaacagtgcgatcacgacacctgctgtcgtaccaacagtagatccggcggctccccattttgccacacttccatctgtaccatcggtaaaatatttaatgaacatccaggctgcgatcagactgactgccgcattaaaaatctgttccagtatctgcgagatcgaagttggcatcatattacggtatgcctgaaaatatcctctgtatacacccaggattccggaaaggaaaatcgttggtgataagatctgcaatgccagtactgcattcggctgattgctcggaataataaatcttgccccaaataaacacaccagtgctacgattccacctacgattgccgcatagatcagagatccatgaaaaatcttctgggcatttttgtaatcttttaaagcaattcgttctgaaatcagtttggaaactgcctgcggaatgctgaaggatgcaatcatcagaagaatcatataggcattctgggcaaggctgatatatcccattcccatattgcctacaattgatgaaagcgggctcttataaagaagaccgatgaccttggagatcattgccgcaaccatcaagaaagatgcattttttactaagttgttcttctggttcatgtttactccttaatttcctgctgttctttattttcaatctgccagtcgatcggctccaaaccattctgaatcagaaattcatttgttttgctgaaatgtctgcatccaaaaaatcctctgtatgcagagagcggactcggatgcggtgcttccagaatcagatgtttcggattggtcagcatagattttttcatctgtgccggtcttccccaaaggagaaatacaattggacgatcctgctcattcagaataccaattgcagcatcggtaaactgctcccatccaatacctctgtgagaattcgcctgatgcgcccgcacagtcaggaccgtgttaagcattaaaacaccctgtctggcccatttttccagataaccgttatccgggatatagcatcccagatcatcatggagttcctgatagatattaaccagcgatggcgggatctctacatctctttttacagagaaacacaacccatgggcctggccatcattgtgatacgggtcctgtccgagaatcacaacttttacctgacttagtggcgtgaaatgaaatgcattaaacatatcatctgccggaggaaagatcttgtgtgtctgatattcctgcatcactgttttgtatagtttcgtataatatggctgatggaattcgcctttcaatgcttccagccattctcctgataaaggagccatgtttctttcacctcttatcttcttacggagattcctctgtctgccagataatctttcacctgactgatctccagttctttataatggaataaagatgctgcaagtgctgcatctgcgccaccctctgtcagagcatcataaaaatgttccagagtcccggctccaccggaggcaataaccggaatgctgactgcatctgaaattgcacgtgtcagttcgatgtcataacccgattttgttccatcacagtccatgctggtaagaaggatttcccctgctcccagtgcctctgcctttttggcccattcaatcgcatccagtcctgtatcaagacgtccgccatgtttgtagatattccagccacctcccggtcttctcttggcatctatagcaagcactacacactgactgccgaatttctctgctgcttcacgaatcagctccggacggtctattgcagcagaattcacagaaatcttatctgcaccctcccggagaagcttcttaaaatcatccacggtacgaattcctccgccaaccgtaaatggaataaatacacaggcagctactttacgcaccatatcaactaccgtatcacgttcttcacaggatgctgtgatatccagaaaaaccagctcatctgctcctgctgcatcatatgcttttgcaatctcaaccggatcaccggcatctttcaagtccacaaaattaacgcccttaaccacccggcctttattgacatccagacagggaatgattctcttggtaaacatatcagttcccctccttttccagtttcgcaaaattttccaggatcttgaggccgtatctgctgctcttctccggatggaactggcatgcaaatacatttcccttttcaacagatgcatggattgttgtgctgtagtctgtcactgcctttacgatctccggttcttctgcatgcagataataggaatgtacaaaatatacatatgtgtcctctggaattccctggaacagtcttccgttattctgcagatgcagcgaattccatcccatatgcggaatcttaagtccttctgccggtggaattctcagaatttttcctttcagaataccaataccctctactcccggtgtctcttcactgctctcaaaaagcagctgcagtcccagacagattccaagaaacggcgtattattttttaccatatctttaatgaccggtaccagattgtatctgtgcagattctccattgcctgtccaaagcttccaacgcccggaaggatcgctttatctgcttttaaaagcacctctggatcccgggaaacgatcgtctcctccccaatatatgcaagtgctttttctacgcttttgatgttgcccgcatcgtagtcgataattcctatcatttgtctctcacatcctgtcttcattgatattattccagtataacccaaaaaaagacagatgcaaagcgatttctttacatctgtctcgatttgtgctgttttactgattctttctgtctaacgtgaaccagaattccacaccattatcatagttctgcactccatactgctgatggagaccttccataatcgccttaacgatagataatccaataccgctgccaccatattctctggttctcgccttatctaccttgtagaatttattccagagattcgggatatcttcctccggtatcggtgtacctgtattaaataccgttactttcacatggttctcctctgtcaggacacggatctcgatctctttttctccatccagatgattcaatgcattgcttgtataatttgtcacgacttcttcaattttaaattcatctgcccatacatagacaggcttttctgcatcaaagccgacctttgcctctttttgctggatcatgatatccatagactgcagaactccccgtatcagagtgacaatatcaaagcgttctacggtcatttcatctcttccggattccagctgattcaaagtaagaaggttacgaaccagcttattcatcttagatgcctcatccatgataacatcgcagtaaaactcccggctttccggatcttcggaaatattttctttcaatccttctgcatatccctgaaccagcgcgatcggagttttcagctcatgagaaacattattcaggaactcctgtctcatctgatcgattcgttctttattctcaatatctttctgtaattcattgtttgcagatttcaactctgaaatcgtcttttccaactgttcagacatacggttgaaattttctcccagctcatcgatctcatttccggcatggctctgatatttggcctcaaaatccagttcactcatcttcgtggaaagcagtgtcagttcactgatcggacgcgtgattctctttgtcacaaaccagatcacaaatccactgatcacaatgatcaaaatgccaacatagaaataaaatttattcgatatggaaacgctctcacgtatgctctccagtggcgttcggatcagaaaatagcagccatttttgagttctccccaactctccacatattccattccagcaaagcggtccctcacctgctgtataatataattctcattttgctggagtgtttttgcatgatcatcctttttctgatccagatcataagcataaccgaccagtcgggcctccagaagatcttcattgcttccgacagaacatactgtctgtccatctgctgtgatcactacccaggtaagattattctctgaactgtctttaaacatttcatcagaaatatctgcactgcattttccatctgagtctgttgtcatcttcagcgcctcgagattttttacagcttcctgtaatacatctgtctttttgctgatataataatgttccagaaaaagtccattgatcacggttgtgatcaccatggagagcaggaatagcccgataaaccaaaattcaatctgccgtctcagcggatgaaacttccttttttctgactttcctgccgttttcttctttggtttcatacttcatctacctcaaatttataacccattccccagacagtcttaatgtattcgcctttttcgcccatcttgcttctcagttttttgacatgggtatcaatagtacgggcatctccaaaatagtcataattccatacagaattcagaatcttttctctggaaagtgcaattccctgattttcaaggaaataagtaagcagttcaaactctttgaaactcagttccatcggcttaccgtccacgctcgcctgatgtgctgatttgtcaatcacgatgccgccggcagagagaacatcatttcctgcatcctgtccggttcttcgaaggatagcctctactctggctaccagaattttcgggctgaatggtttcgaaatatattcatccacaccgagatcaaacccgagaagctcatctctctcatcgcctctggctgtcagcataatgatcggcactttagaatttttacggatctcacgacatacttcccagccatccatcttaggcatcatgacatccagaatcaacagtgctatatctttttcttcataaaaaatatccattgcctcttcaccatctccggcttccagtacatagaaatttttcttttcaaggaaatccttcacaagcttacgcatacgactttcatcatctactacaagaatctttggggcttccatttttcattcctccatcaaacatttactttctattttgttttatcttagcagagatttatgtaagttttgtgaacggatagcagaaatttgaacagaattagaagtaatttttcataaaataaaaaccggaagccatagaaacaggctccggttctccattgtcatattttctgctgtctttatgaatgatctggaattatgcaagtgctttaccaagtgctttacagctttcaactgcatcatcatccggctcttcctggcagatcacaccatcagcaactaggactgctccatcttctttgcatttatcttcccagttgtgcatccattctccatccccccatccataggatccgaaaagaccgatctttttaccagaaagctttgcctcacattcgctgaacattggctcaaattcatcttcttccagtacttcatctcccattgcagggcatccaaatgcgattgcatcaaattcatctactttatctgctgaaaaatcagctgattcaaaagaaataacttctgcacctgctgcttttgctccttccgctactgcatttgccatagcttctgtgtttcctgttgaactccaatatactactgctactttactcatcttgatttaccttatcctttctgtttatgctgcaacagtcagctgaagaattgatcttccatccgcaaaaagtcgtctgtagatttctgaacatttcttcagtttccggaaaagcatctgagtctgcttttcatttccatatactttccagattccgcaacatttataatttttacctttctgttcaataaatccagtcacgtcatcaagaggatacccaagaaaaagcccaacttcatgtggaaaaccatctttttcaaaaaagcgctcctgaagctgtcgaatacagcaatctgtctcctgacattcataaccgcagtctttcaaaagagcacatgcaccttcacactgcagatcctgttccagtttctttttgcggtatacatagaccagtgccttatattcacttgttctgagcacttccacaaaaacacctctgcaattcagttttctgttttcctcttcaatttccatggacagtttatttctgttcattggtgtataagtaaacatatttgcagttttgattcctgctagcgtaggtgcacagtgtgctatgatctcagcttctaacatccttaagtctcccgttgattagttgtgtctaacctattgttttaaatttacggatatgtttccatatccgtaagtttttatttgttagctgcttctaactaacatgatagtacaatacttttcactcgctgtcaagagttttctttaattaacttttcatatcctgcactgactttagagtacagatttcatagagtccataccaatcagtaaagttgaagtattatgaagcaatgcagacatagtcggctgaatcactcctgttacaccaagagcgatcagacttccattaataccaacgatacgtctgtaattcttatggatcttatccatcagaccattgctgatttccttaagtgtaaccatgacactcagatcatctgccccgatcgtgatatccgcaatttctcttgcaagttctgctccatcactgatcgcaataccaacatctgctgcagaaagcgccggagagtcattaattccatcacctaccatcaggactttacgtccctgtgctttagcttcttctacgaattttgctttgtcctccggaagtacttcagaataatatttatcgactccaactctggttgcgattgcttttgctgtgcggtcactgtcacctgtcatcataacgatctgtgtgaaccccgcttttcgcagtgcctttacaacctccggtgcctccgggcgaagcggatcttcaatgcagatcaccgcggcaagtttcccttcaattccaagatacagatgagaatattcttccggaagatttctgaacaattcttcctttccgaccggaattgtacatttttcatcttcaaatacaaaatgatggcttcctataattgcttttcttccatctaccattgttgaaattccgtgagctacaatatattcaacttttgaatgcatttcttcatgagtcaggccacgttcttttgcagcatccataactgcttttgccatggaatgtggaaaatgttcttccatgcatgcagcaagtctgagaagattttcttttgaatcaccgttaaaggaaactacatcaacaactgtcggctgtgccttcgtcagtgttcctgtcttatcaaacacaatcgtatctgcctcagcaactgcttccagaaattttccacccttcaccgtaatatgatgtgcatttgcctcacgtatcgctgcaagaacagaaattggcattgcaagtttcaatgcacaggaaaaatcaaccataagaatagacaatgccttggtcacatttcgtgtgagtgcatatgtaagagctgtaccagcaagtgtatacggaaccagtctgtctgcaagatgttctgctttgctctccactgccgatttcagtttttcagtctcttcgatcatggttacgatcttttcaaacttggtagagccagaagtttcttttacgcgaatggtaagttcaccttcctccataaccgttccggcatatacataactggattcatgttttgccaccggcatggattcccctgttagagacgcctcatttaccatagcctcgccttctgtaacaataccgtcaaacggaattacggttcccatatgtatacggactctgtcaccaggtttaatttcatctgttcctacctgaacttcagaatcctctgttatcagccataccttgctcacattcagggacatgcttcgtgccagatcatccacagactttttgtgtgtccagtcttcaagaatctcaccaaagccaagaaggaacattacggaagaagctgtactgaagtcacctctgagcatggatacaccgatcgccgttgcatccagtaccggaacttcaattctgcattttgcaagtgtgcgcacacctttccagatatatttcacagatttcagcgttgtcagaaatgtccggaccggaagtggcaggaatattttcttaccataatggagcacaacatggtttaccatcttctcccagtattctccattcatttctcttcctgaattctgaagataactttccggtgcctcagccttttcataagaaaatctctgaattgccctcagcatttcttctctgttatcagaataacagatcactacgtcttgatttctctctactactttgacagagattacaccattcagttttgtcagaaaatattccaactgatctgcctgtctgcatgtcattcgtttctgacagatatgaagtctgactctgcctctgatttcatgttctattttgaatctcatattgtcatcacctttagttatgaaaaacacctgcagtttctctccgcaggtgctttgttcttattcctcttctgctgcagtttcttctgtttctttaaatgtttcttcttcagcagtatcttcaaatgcttcctcagctgctgcgcgatcttcgttgatctgctgtgcttctgcataaatatcttctgcgttctcctgaaccttggatacaattttcattacgcagtcttttgcacgaagaacagctgctgtacagttcgtataaactttttttgcatctttgctggaaagaagtttgattcctgctgttccgaataatactcctgccgcgaatactccgctgtgtttcttatcaagtttgatcattgtaatatcctcctgtatatttcttttttaacattacacatattataaaatctccaaaacaaaagtccagactaacttgcaaaagtgataaattttctcattatcatctaaaaacagagtaatttacttctgttttttgcgtattttcttccgggagtccattagttgctattttcaacggatacgcgtcgtactctccttgactgaagatatccgcaggattccattcctttttcaataatcttgcaaagtttttcattatccagccggatatttgtctgatcatccagttgtacacagcagacaggtacctgtccctgttcatcgcagatgcgataagcgcttttccttttcagggcaccgatttcttctagaagattaatcattctgtatactgtcgccattccaatatttggatcctttttagatgccagaaaatatatttccttacaacaggtacattcttcctgcaaaataatatccagtatgatctttctctgttttgtaatcctgcagccttcccggcgaagtctgtcaacaatagcactccgctgcatgctgcttctctgatactgctgattacggaaggattcctgagcaggatctgatgtataatcatatatttcctctcgcagtgcttccattttcgttcctcctgatccgttcagtttgttttgtcttactatttgtttcgagcaacttctgttcgctatatctatcatgagtttacatcttctaactgtcactgtcaagttttttcagtattttataaaaaggttataaaaaccaagttcttcccttgacaactctatatacagtttcatataatagaaaaagtcagaaacacaagcatcgtctgtttaccagtaatatcggatctttccgaacctgatcagggcttgtactggtttcgacgggggctttgaagttgaggcagccatccgcagactcctggactgcgtaccaaccgggaaactaaatataaacgcagacgaacagtacgcgttagcagcctaagtgctgctcatcagccctgatgcactcacacatcaggaatctggtgtcgactatgtgagaaaccttgccgggtaagctttgccccggtagatgtatcatgaagctactgaagcaataagcctgtcgatgggcgtattgccaagggaatgttaaaacagcgactgtgatgggagacaccgcaagggataggctttcggacaggggttcgattcccctcaggtccatttttaatatggcagatagcgtaaacataaaaaatgtgaagtcttaattatcaagacttcacattttttatttatctgttatattttcaactgattatatattactcggccattctcttctgaactgtttcaaattcatcaatgatctcttttgacggagcctttgttgcaaggcttacaatgacaatcatagcacaggaaaccaaaaatgccggaagtaattcataaaaattcaggaaagatacatttggacgtacaaggtatttccatacaaataccataacaccaccagaaatcattcctgccagtgcaccctgccagttcgtacgtttccagaacaaagcaaacaatacaaccggtccaaatacagcaccaaatccagcccacgcaaaagatacgatgttaaatactgagctgtccggattacgtgcaatgataaccgctacgactgcgatcaaaagcaatgtaacacggtcagcaaccatactctcattcttgtcagcttttttcttcaggatatttccgagaaggtcagaagatactgctgaagaagctgccagaagctgtgaatctgcagtagacatggtagatgcaaggattcccgcaaggatcgtaccaccaagcagtgccggaagaacgccatatgtactcaaaagatctgcaatcttaacaatgattgtttctgaattagatccctgaagcatttcaagtttgcctgcttctgtcattccaaggccgatcacaccgatcagtactgctacagcaagtgagatcactacccatgtagtagctactcttcttgataaggaaagtttcttttcatcttcaattgccataaatcgaagaagaatatgcggcataccaaaatagccaagtccccaggccatcatggaaacaatatttataacaggatatgcagactccgttccacttacaggatcataagttgtcatcatggtcagataacccggcagtgatttcgcatgatcaataaccgccgaaggacctcctgctatagataccccaaaacaaaatacgatgatcagtgcaatagacatgatgatgctctggataaaatccgttgttgatgcggcaagaaatcctccgagagtcgtatatccaactataacaagggcactgatgatcattgctgtgagatattttactccaaaaaggctggagaaaagttttccacaggctgcgaatccggaagccgtatacggaataaagaaaataacgataaaaatagctccgatcgactgtaacagatgtctgttgtctctgaaacggttgctgaagaatgatggcaatgtaatcgaattgcctgctacatgtgtgtagagacgaattctctttgcaacgatcttccagttaagatacgttccaattgcaagtccgatcgcagtccatccggcatcagcgattccagacagatacgccagacccggaagtcccattaaaagccagctgctcatatcggaagcctctgcactcattgccgtaaccaatggtccaagtttacgtccacccagataaaaatcggatgtgtcattatttttcttggaacagaggtagccgacatagatcattgcacccagataaacaatgattgctatcatgatgcagatgtgtgaagttgtcataagttcctctcccttctgaaatggaatgcatatttattcatattctgatatgcatatacctacaatattattcgaaaactacagaaaagtaaagaaaattcttagcaaaaaacgactctgtttttataaaaaatcaaaacacacaaaaaccatcggaaatgctttaaaaataacataaaatctaccaaagaagattctatgatttgtcgaaaaatctaagaaattgtctgacgaatcatattgacgatataccttcctgaattatagaataatggcgaaacctatagttattgcacaaacggaggattaaaaattggaaaacaaaaacgaagctgtaattgcaaactacatcgaaaaaatgatgggagaaaggagacagaaaatatttgaatcggatgagtatattcagcaggacaacggtgatctggattatctggaagaacgctacagcagtctgaaaataccttatgtgatcagaagagtcgtagatgattatattgcatgcctggaatcaagggatgaacgatacgcagacatgtcctatgtagcaggcatgggtgatgcaatatcattacttacaaaaatgggaatgttaaataatcaggaacagccgctcagtatcaatgctgaataaaacatggaatgaattcaaatatacaatactacatattatcgtttatgcaataaaagactatatttattttaaaaaaaggcatagccggggaaatccggtggcgcaaaactatagggtctaagcaaatgtatgacagccagttgcaggagagatacatataactcttttagaacagaaaaaaagttgacgaccatccgtggtttcaggatgaatcgtcaactttttgtattttttatttccgtttaccacagataggaaaagatggatgctccgattactgtgcacagaccgcacacaacgatagcaagactgctcattgctccctcgacttcacccagttccattgctctcgcagttcctactgcatgggatgccgtgccgattgcaaggcctctggaaatcgggctcttaatacggaaaagcttacagataaattctgctgccatatttccaagtactcctgtaatgatgatcaccgcaacagaaattgtcacatatccgccaagttcctcagatactcccataccgatcgctgtagtaatagattttggaagcatcgttacatattctttatggttcagaccgaatacgactgacattgcaagtacggttccaagacttgcgagcactccggaaaatacaccaacaagaatcgctactatatttttcttcaacagatccagctgaagataaagaggtatagccagacagaccgttgccggtgtcagaagatagctcagatatttggcactcatattgtaactttcataatccacatgaaatactaccagaaacgcaattacaagtatgatggaaatcaacaatggatttaaaactgccagtttccatttgcgctgagcagccaggccgatctcataagccagcaggctgatcacgattccaactgttgcagaactcaaaatcagattatccattcttcttctctccttttcttgaaattaagaaatctgtcacttttcctgtcacaatcataactacaaatgtagatactactgttattacaagaagtggcaccaggaaagactgcaactgactccaggacgtaacaagtcctacacctgccgggataaacataagcggcatgatctcaatcagaaattctcctgtttcttttacgtgttctaccttgatcacttttgcaagcagaagcacaaacatcagaatcagtccataaatactacccggtattggaagcgggataaaatatttcataatctcccccgcgcaggtcacagccagaatgattccaaactgtcttaaatatttcactttattcgcctcctgagtttaaatcttttattacccttgttcttttattatgagtaacaaactttttctattatagcacactgcattttgtctcaacaagtcaaataaagtacaaaaaactgccgatattacagcagttttttatataaatgtttgattaatgtcaatttttagctatttgcggttctgataactaaggatacatcccaagtatttctacgaactcttgcagatgcatctgtacccgtagtggttatatccagattctctcttcagttttaattgatggggtgtagtcatgcttcgcactttaggaaataaagtatggtattgggaattctttatttctttattataatgtcttccagttttcttttgggtacgtaatgtacatcgttctcatcgcggtaataggcaatgttctcgccttcctcgatttctttgatcacaattttttctgccggcttgccaaatgccacgatcagcaccggagcgagattttcggcgaggtgcagttcttttttgacggaatcggcattgtagtttccaatcatgcaaccgccaagtccacgttcagctgccgccaaaagcatggtctgtgccacaattccgacatctttctggtatctagggatggaagctccaaggttcagatcctggcagatgatgataaatcctgtcgggcacatgcccggatgaggaagctgcatctgcggaagcgcccgcgcccagtttgtcagtttctggattcggtctacttcttcattctcccatgccagataataacgaaatggctgggcgttcacgctggacggtgcaaaacgcgcgcagtccacgaagtcttccaactcttctctgctgaagcgataagattcatcatatcctctgtagcttctgcttgcttttacaatatctttgaacatgtttattctcccatatctttcgcgcatacctttaatttttctctgattggcagatgatatggacatcttggctcacatttgccacagccaatgcatgcagaagcttttactttcagcgtgctgtagcgttctttcgcccagtctgccagatcatatctctgcagataaccggcaaagagaaatacacttgggatattgatacctacggtacatggtgcacagtaattgcagcgacgacagaaatcatttccaagctgcgcgcgaacctcctccatcttcttgagttcttcctctgtaagaggtgtagaatcagagcaggctgccatattttcgtccagttcacggatctctgccattcctggaatcacaacagtcacatccggattggaacagacatagcgaagtgcaagtgtaccatcttcgattgcgccaccggcaagtggtttcatatcaataaatccgatatttttttcagcacatttgcgaatcagttcagcgccctgctgctctacaatattatatggaaacataattgtttctacccaatccagctccaatgcacgctcaaaaacagcagtggaatgcgcagtcagtccaatgtgtccgatttttccagctgctttggcttctataagcgcctccagtgcaccgccctctccaataacctgatctagctgttccatgcttggattatgtacctgatacagatcaatatagtctgtgcggaagttattcagacttgtctcaatatctgccgccattgcttcttttgttcttgccatggattttgtcgcaagtacaaatttatcacgaattccctccagcccataaccgatataccgttcactgactgtgtatcctctcgcggaatcaatatagttgattcctttttctgccattgcatgaagaagcttctttgtcccttcttcatcgattttctgaatcggaatgcctccgaatcccatacgtgaaatcttcaatcctgtttttccaagtgttctgtactccatatcatgtcctccatttctattttaaccaaaattctattttcggcaacgatttctcactttttgctctttttctttgcttttccacgaatcagcacagtaaaaaaataccaccgaatctctccggtggtatcttaacttgctactgctcactacgttcgcagcaactattcatcctattaattatacacgagacagatattcacctgttcttgtatcgattttcagtttatctccctggttaacgaacagcggaaccattacctgagcacctgtttcaacagttgcaggttttgtagcaccctgtgctgtgtttccagcaaatcctggctctgtctcgataacttcaagttctacaaacagaggcggctcgattgcatatacatttccattccaggaacaaactttaacaacttcgttctctttaacgaatttgagagaatctccaacctgttcttttgtaagtgcaacctgatcatatgtttctgtattcatgaagttgtaaaggtctccatcattgtacagataactcatgtccacacggtcgatacgagcctgtgggaatttctctgtaggacggaaagatttttccagtacagctcctgtgataatgtttttatattttgttcttacgaacgcagcgccttttccaggttttacatgctggaattcaacgatctgacatacgtttccttcaatttcgattgtgacaccgtttctgaaatcacctgcagaaatcattttattatcctccttcgttttgtgttcgctaccagttattctataatatacaggaagttttttcaactactttttttcataagaagccaatttctcttcaatttctttaataagctcctcaaaaggcacttctcctgtcgttacctgaatatcagcaaacttctgatataccggatctctctgtttcagaagtttcttgatcttgtcatctctgtcttccccatccagcatcggatcttttttggatccctccagacgtttcttgagcgttgccagtgatcctttcagataaacaactgtaccaagttctctgagatatttttcgttctgttcctgcagtggaagacctgctccaagtgaaatcaccttgcgctctgaatcctgaatcagctgtttcagtgccagagtctccaatgcacggtaatacggctctccgaatctctcgaatatctctcttgcagaaagattcatcctctttgtaatgatcttctccagatcaacaaatggtaatcccaagtctttggaaagctgctttccaactctcgtttttcccgaacccataaacccaatgatcaccacgtggttcatgaaatcccctcctcctttttgtaaaaatgtaatactattttttccagataacgtttgagcacaatctgaatttcttcttttggatgaatcggcttcaccagaatattacggatgccgcttcttttggccccatatacatctgtgaaaagctgatctcctataaaaatggtatttcctgtgtctgttccaagaagttccattgctttcttataattacgtacagatggcttgtgcgcattctcaataaactgtgcgccaatcgcatctgcaaatgaggaaacccgctcaatctgattgtttgacaacagacaatagccaaatccaagttctctcaaatgtgcaaaaagtgcaattgcccgctcatctgccggtgccccgtgaggcacaagtgtattatcaatgtcatagatcagaccgcggtacccttcgcggtaaaggcggtcataatctatcacatacgcagaatccagatattcatctggaaaaaaacatcgaaacattattttctcctctgttgtctgatcttatctctcgctgagaggaatatattctgcctcaggcagaacattcttatatgccgggcggatgatcttatctgtattgatcaactcttccattcgatgcgcactccatccaacaatacgtgccacggcaaacatcggtgtatagagttccagtggaagatccaacatgctgtatacaaatccactgtaaaaatcaacattggcgctgacacccttataaatacggcgttcttctgcaatcacctgtggagccatccattcaaccatggaatacagacgataatctttcatacgtcctttttcttttgcgaggctttctacaaatcccttaagaacttctgctctcggatcggaaacagaataaattgcatgtcccataccatagatcaggccacgtctgtcaaatgcttctttatgaagaaggtgtttcagatatgcacgaacttcctcttcatcttcccagtcacggacttctttcttcatatcctggaacatctgaataaccttgatattcgcaccgccatgtttcgggcctttcagtgagccgagtgcagcagcaattgcagaatatgtatccgttccggatgatgaaacaacatgtgttgtaaatgtagagttgttaccaccaccatgttccatatgaagtatcaatgccagatcaaggatcttcgcttccaaatctgtatattttttatctggtctgagcatccgaagaatattctcagctgtagaaagttctttcttcggattgtggatataaagactcttacctctcacataatgactgtatgcctgatatccatatacggaaagcagcggaaattcactgatcaggttcaggcactgtcttagtacattcggaagtgaaatatcatctggattattatcataggaatataaagtaagcacgcttcgtgaaagcgcattcataatatcacgtcccggtgctttcatgataacatcacgcacaaaatttcttggtaatgaacgctgggctgccagcaaagcctggaaatctgcaagttcttttgcacttggaagtttaccaaacaaaagcaggtaggtcgtctcttcaaatccaaaccgattatcattgacaaaacccgccgtcagatctttgatattataccctcggtaataaagacttcctgcacagggaacttctttcccatcaataactttaaccgcctgtacattggatatctgtgtcaacccggccagaacgcctttaccattgatgtctcgaagtcctctttttacatcgtactttccataaagtgacacatccatactggaatgatctacgcacatctgtgtcagattttcaatttccggtgttacttttgtgttaaattctgtcatgcatgatactcctttcgacttatgcttctttttcccgcaggccctcctcaaaataaatctctaatctaaaataagtataacatttcctgtcatttcagtccagttatctctgctgatatgtgcgcagaaattctctaagtttttccattgacttctcaagctgtcttatatttggaagataaacaattctgaaatgatctggtttcatccagttaaagcctttgcccggaacgatcagtacctgtttctcatgcaggaaatcaagtgcaaactgttcatcatttgtaatattgaacttctcggtatcgatcttcgggaagatatagaaagcagcatgaggttttactacagaaattcccgggatatctttcagtgcattatagatgcactctctctgctcataaactcttccacccggtttgatatactctgtgacactctggtatccaccaagtgctgtctgcacgatcgactgtgccggcacattggaacaaagtctcatagaggaaagcatcttgattccttctatatagccttttgccttgtcctttgctccacttaagatcatccatccgatacggaatccagcgatcatgtgggatttggacaatccggaaaatgtaacacagaaaacatccggtgccagagaggcaatggatgtatgctcatatccgtccataaccaggcggtcataaatctcatccgaaaaaatgatcagttctttttctcttgcgatctgaacgatctgttcaagaatttctttgggatatactgcacctgtcgggttattcggattgatgatgacgattgcttttgtcttatctgtgatcttgcttctgatatcatcgatatcaggataccagtctgactgttcatcgcagacgtaatggacaacgtttcccccggccagtgtagctgtagccgtccagagcggatagtccggtgccgggatcagaatctcatctccattatccagaagtgcctgcatacagagattaatcagctcacttacaccatttccagtatatatatcattcatggaaacatttggaatattacgaagctgcgcatactgcatgattgccttacgtgcagaaaagattcccttggaatcggaatatccctgagatgtacggatattgctcagcatatccagaatcacttcctgaggagctgagaatccgaacggatacgggtttccgatattcagtttcagaatttctttgccttcctcttccattctggccgcctcatcaaccaccggtcctctcacatcatacagtacattatcgagctttgttgatttgtcaaatgttctcattttttcactcctctccgtgaattttttattcatatcggtcactggaatcctatattcagtaactcgtattgtactataatctcacattccgctcaatttcgcaaggtaaaattctccacaactcgtatcataaaatcatataaattattttttagtatgtcttaataaattttttgaaaaaaatttttatgatacccttttcaactttaccacttttgtgtataatagtccctggacaaatgtcttagacagatagacataattcataaaacgaatgaggaggaaatcaacatgtcttacacagaagaagtttatgaaagagtcgttgcacagaatcctggcgaaccagaattccatcaggcagtcaaagaagtactggattctctgaaagttgttatcgacaaaaatgaagaaaaataccgcagtctttccgttctggaacgtctggtagagccagaaagaatcatttctttccgtgttccgtgggtagatgacaacggcaaagtacaggtaaacaaaggataccgtgtacagttcaacagtgcaatcggaccttacaagggtggtcttcgtttccatccgacagtaaaccagagcattcttaaatttctcggcttcgaacaggttttcaaaaactcccttacaggtctcccgatcggtggcggtaaaggtggttccaacttcgatcctaagggcaaatctgacagagaagttatggcattctgccagagctttatgacagaactctgcaaatacatcggcgcagacacagacgtaccggctggtgacatcggtgttggcggacgtgagattggatatctcttcggacagtacaaacgtgttcgtgatctttatgaaggcgttctgacaggtaaaggacttacctatggtggttccctgatccgtacagaagctaccggatacggtgttgtatatattctgaacgaactgatgaaagaccacaacgattctcttgacggaaaaactgttgttgttacaggttccggtaatgttgcaatctatgcagtgcagaaagctactcagcttggtgcaaaggttgttgcaatgtgcgactctaacggatatatccatgatccaaacggaatcaaccttgacattgtcaaagatatcaaagaagtaaaacgtggacgtatcaaagaatacgctgaccgtgtagaaggtgctacttacacagaaggtgttggcatctggaacatcaaatgtgatgtatatcttccatgcgcaactcagaacgaacttgaccttgatggtgtaaaaactctgattgcaaacggatgcaaatatatcgtagaaggtgcaaacatgcctactacaagagaagctacagactacgctatggcaaacggtgttctcttccttcctggaaaagcatccaatgcaggtggtgttgctacttccgcactggaaatgagccagaactctcagagactttcctggacatccgaagaagttgatgccaaacttcatcagatcatggttgacatctatgctaagatcagcgatgctgcaaaacgttatgatatgccggacaacttcgttgttggtgctaacattgcaggtttcgaaaaggttgtagatgcaatgatggcccagggtattgtttaatctcctgttcattcgtaagtataatccaaaaggcgttccggatttctgatccgaagcgcctttttatattttcatgttttctttatggttccataaatttcttcagttcatccataaatgtactgacatccttgaattctctgtagacagaagcaaagcgaacataagcaactgcatccaggtccttcagatgttccatgacaatctcaccaatgcgggtactggaaatttctttgtctgctgtgtcaaaaatatctccctctatagaatccatcagcgactcgatcttttccaccggaatcggtctcttatagcaggcacgcagaattccgccctgaatcttggaacggtcatactgttcacgtgtctgatccttcttaatgacactcaatggaatagtttcaactttttcgtatgtcgtaaatctttttccacaggattcacacattcgccgtctccggattgaatttgtatcatctaccggtcgggagtctacaaccttgctgttatcctgattacaaaacgggcatctcacagtattttcccctctttccccttttaatgaaataattatactttattttttcgaacaatgtcaagaaatgcacctgtatatttcagataaattttgcatatcttttataaaaagtggtaaattcatgcgattatgtgagcttagacagaaagaagtcatcaatacctgtacctgtcgcagtcttggctgcccggtcgatctggagttcgaccgcaaaacaggagccatcactgctctcatcgttccaggtcccggcaaattctgtttttttcccggcagagaaagcgaatacatcattccctggtgctgcatctgccagattggtgatgatatcatcctcgtcgaagtcaaagaagaaaaatgttttcacaaagaccaccttctctgacactgtcaagggctattaatttttatatttttcccagaaaagaatatttcctgtcctccctgagaatcatttctagtaccagaaataagagatgaggaggatattttgatggcacttaataaagtagaaatctgcggggtaaatacatccagtcttccgatcctgaagtcggacgaaaaagaagcattatttcaaaagatcaaaaaaggagattctgaagctcgcgaacaatatatcaaaggaaatctccgccttgtgttaagtgttatcaaacgatttcagaacagcaatgaaaatgccgatgatctttttcagatcgggtgcattggtcttatgaaagccgtcgataattttgacgatacactgaatgtcaaattctcgacatatgcagtcccgatgatcatcggtgagatccgccgctatctacgggattataacagtatccgggtaagccgttctctgcgcgacattgcctataaagccatttataccaaagaaaatatgatcaaaaagaatctgaaggaaccaacgatcgatgaaattgctgatgagatcggcattgaaaaagaaatgatcgtatatgccctggatgcgatccagagtcctgtcagcttgtttgaaccggtatactccgagggtggcgatacgctgtatgtcatggatcagatcagcgatcagaaaaacaaagaagaccactggctggaaaacctatctctccgggaagccatgaaccggcttaaccagagagaaaagcacatcattgaaatgcgcttctatgagggtcggacacagatggaagttgctgatgaaatcggcatctctcaggcgcaggtcagccgccttgaaaaaaatgctctgaagaccatgaaaaattatctgagatcctgaaattgctttatatgcaaaaagcctccctgccggaccaattgccgacagagaggttcttttttatttcagtgctttctcaatttcttcaattacaatcttcagtgctttgatacgtgcatatttcttgtcaacggactccagaatatgccacggtgcaaacgttgtacttgtcttcttcagcatctcatcgactgcttcttcatactgatcccatttttcacggtttcgccaatcttcgtctgtgatcttccagcgtttctccggattattctggcggtcattaaaacgctccagctgtgtatctttatcaatctgcacccagaatttgatgatcactgcaccccagtcgtggagttccttttcaaattcattcatctcattgtaagcacgtttccagtcattttcactgcagaatccttccagccgttctaccatgacacggccataccacgtacgatcaaagattgcaatgtgcccatccttcggaagtcttgtccagaatctccagagataatgccgagccttctcatgtggctccggactggcgattggctgtacctcatatcctctaggatccaatgcccctgcaattcgtttgatattgccgcctttgccggccgcatcccatccctcataggtaatgatcaccggaacccgcttacggtacaggcgattatgcagttctcccagtttagcctgcagcttcttcaattctttctggtactcttcttcgtcaattgtcttgccttccagctctacgtctttcaacttaggcatcttgaccagtggaaagacattctgaaggatcggtaccgaatgactctggttctgcaatgccacttcgatactgctcaccaatgtatccatcacctgcagctctgcccacttcttatcctttgcatcaatgatataccacggcgaactggacatattggtgtctttcatataacggtcaaatacattctcgcacttcttataatgtttgttctgccatttatcgaatcctgtcacacgccacttggtatcatccttggaaagcagcttcttcatacgtttttcctgttcgtccttatcaatctccataaagaatttcaggaccagatatccattgtccgtaagctgcctttcaaaacgcctgatgctctcgatacaccgctcataagcatctccttcgagttctccattcaatacttccttcaccgtctgttccatccatccggaatccaggaatgtaaatttgccttcttccgggatctgtttcatataacgatacagaaacggtctgcgtacctcttcctctgtcggagctgacatcgtggcaaccttgaaaaaacgaggatcaatattcctgatcaccttaccgatcatactgcctttgcctgctgcactccacccctcaaaaaggaccagtaccgggagcttgtgctccttgatcttcatctgaagatcataaagtctgtttctggttttctcaagctgtactttcatctcatctttgtccggttcttcgcccggtgtccatgattttaacatattgagcccccatttctttttgttgacagtataccacgtctggaataaaaatacagttaattgttgcacatattgcgccatttttttctcacagattaccgaatatacaaagagacagaactccagattatcaggaaattctgtctctgtaatattttttatgaaagttccagtttaccagtatacagctgataataagttcctttctgtttaatgaggtctttgtggtcacctctctcaatgatcttgccatgttccagaacaataatcgcatcactgtttcgaatcgtagaaagtctgtgcgcgatcacaaacacggtacggcccttcatcaggttgtccatacctttctgtacgatactttctgtacgggtatcgatactggaagttgcttcatccagaatcagtaccggtgggtctgcaactgctgcccgcgcaatggacagaagctgtctctgcccctgagagagttcttcaccatccccgctcagcatcgtatcgtatcctttcgggagcatctgtataaactgatctgcatgtgccagttttgctgctgcatagatttcttcatccgttgcatccagcttgccataacgaatattatcacgaatcgtaccggtaaacaaatgtgtgtcctgaagaacgattccaagagaatgtctcagatcatcctttttgatcttggtaatattgattccatcataacggatcttgccttcctggatatcataaaaacgattgatcagattggttatggttgtcttaccggctccggtagagccgacgaatgccagtttctgtccgggcttcgcatacaggctgatatcgtgaagaattgttttgtcttcattatatccaaaggttacatcctcaaatcttacatcacctttcagctctgtataggatacggagccatctgcagaatgcggatgtttccatgcccacatgccggttctctctttgcattctacaatgttgccattctcatcttttcttgcattgacaagtgttacataaccctcatcctcttccggtttctcatcgatcagattgaaaattctttccgcaccggcaagtgccatgacgatggaattaaactgctgtgccacctgcatgaacggctgagtgaagcttttggtgaactgcagataggaagccataacaccaagtgtgattcctccgatgcctgctacagaaaggattcctccgagaaccgccgtcagtacaaactgcaggtttccgatatttccgataactggccccatcatattaccgtatttatttgcctgtgaggcgctctcaaaaagaacttcattgagctgatcaaactcttcttttgattttgcctcatgattaaatacctttactaccctctgtccgttcattcgttcttccacgaatccggtcacatctgccagagacatctgctgatgtacaaagtattttccactctttgctccgatcctgccggtaacagcaagcatcacaaaaatgatcagtactgcaagtatcgtaagaagcggactcagcaccagcatggaaataaaagtgacaacaattgtaaacaatgccatcagtgcctgtggaattgcctggctgatcatctgtctcaatgtatctgtatcattggtataaagactcatgatcgaaccatttgtattctggtcgaagtaacggattggcagtgtctgcatatgttcaaacatatcatcacgtactcttttgagtacaccctgtccgatataaaccatcattcttgtgtaaataaatgttgcaatgacacctgccagaaagattacgcccaaaacagtcagggccttataaagtcctgcaaaatccggggttttctgtccaacaagcggcaggataaaatcatccagaaggtatctcagagaaagagagactgcagttgtcgccacagcactgatcaggatacagaagaaaacaagaataaactggaatttatatttctctgtcacatatttcatcagacgttttgccgtctttaaatcattttttgtcattttcggttttttattcttattcatcctcttctcctcctttcacctgagattcatatacttccctgtagatttcatttgtctgcagcagttcttccgatgttcccacacctgcgatcttaccatcatccagcacaatgatctgatcggcatcttctatcgaagaaactctctgtgcaatgatgatcttggtcgtgtccgggatctcttcccggaatgctttacggatcaatgcatctgttttggtatctactgcactggtggaatcatccagaatcaggatctttggtttcttaagcagtgcacgtgcaatacatagacgctgtttctgtccaccggaaacgttattaccgccctgtacgatcatggtctcataaccattcgggaactcatttacaaatccatctgcctgcgccagacggcagactctcttaacttcctcatcactggccttttcattgccccagcgaatattatcgtagatcgtaccggaaaataatacatttttctgcagaaccatagatacctggtcacgcagaacttccagattatagtcacgtacatcgactccggctacttttactgcaccaccagtgacatcataaagtctcgggatcatctgtaccagtgtagatttggcacttccggtaccgccaatgatgccaactgtctgtcccgatttaatatgaatgttgatatctttcagggaaaggtttccgccttcacccgcatagctgaaatctacatgttcaaaggtaatctcgccatttctgacttctttcaccgcatccgctttgtcctgcatctccggtacctcattaaacacctccgtgatacggtctgtggaagcccctgcgatcatgatcatgacaaatacaaaagtcaccatattcagagacatcagaatctgaatcgcatatacgatcacacttgtcagttctccagtctccatggttccaaatacaatgcttcgtccaccgatcagcgcgatcagaagtacaaccgcgtacatcatgaactgcaggaccggagagttccatgcaacgattttttctgcttttgtaaacagggtatatacataattggacacaccgtgaaatttgtttatctcgtaatcttctcttacaaatgcctttaccacacgtgatgcattgacattttcctgcacagaattgttcagttcatcatactcgtcaaatactctgataaaatgtggatgcgctttctttgctataaacatcagtgttccaccaagaagcgggattacgatcaggaacagaagtgcaatctttacattgatcagcagtgtcatgatccaggaaagaagaatcatgatcggtgctcttgccagaagacggatactcatcatatatgccatctgcacgtttgtaatatctgttgtcattcgtgtgaccagacctgatgtggagaaatggtcaatgtttttgaaagaaaaatcctgcaccttatagaaaatatcatggcgaagatttttcgcataaccagcagccgctacggctgccatattaccggcctgcacaccaaaaaacaatgccagcatcgccattgcaacaagaattattccgcgctgtacaatataaccaagatcaccattggctattccaacatctatgatctttgccatttccagaggaatgagaacctccatcatgacctccagaattacgagaaacggcgccagcaatgactgtttcttatattcccggatggatttaaaaagtgtcttattcatcttttctgtcagcctccttatctgtctttttctatttccgaattttcctattatacaaaatttcgcctttgaaagtcaatcgtttttttgtgactttttggacacaattcaggcaaaaaaaatgcccctcacagggacattttttctttttcgtatacttctcttacttcgtctgcttttgcacgatgcggaaaacagatatttccaagctgtcttaccggcatcacacccatgagtgagtttgtcacaaaacactcctcataatacatcagctcatccggataaatgatcgtttctgtcacctgaaatctttccataatatattcacgcaggatacccggcaacaggccgcaggaaagctgcggtgtatagatcatatttttacgtacaaaaaagacattgcagacagttccttcactgatctgtcctttggtgttgataaatatcttttcattgataccggctgctgcggctgctcttttttccagaacacagtcaccataattaaatgtcttatgataaaccagtggagaagtctcgtttcgtctgactttgcttagatccgtcataaatcctctggaatagatttcatccatatatggattttctctcatctgaaagaaggtattctcagctgacatcacgatcttaagtgctccatgcatcttcaccgacatttcctgtgtactcagatattctgcgattttttcttttgtaagtccacgttctgcacaggaacccaatttcaaaaaatcagctgatccctgcattctgttcagatgttgttccagaagtaacggtctgccttgttccactgcaaccgtttcaaatactcccattccaaacaaaaatccctcatccagtctaatatccatatctttttatcactccagactttatttcatagcctccagaaccgctttcgctttctgaagggtctcctcatattcaaattccagatctgattcagcagtgatgccaccgccaactcccagataatacattccatctttgtgcaatgctgtacggatcactatattaaaatcacagtctccatctaatgtcaggtaaccgatggaacctgtgtacagatttctgcggttgttctccagttcatcaatgatctccatcgcacgatatttcggagctcctgtaatagaaccgccaggaaacgttgcttcaagcagatccattatcgttttgttttcctgaagtactccctcgatgtcagaaaccagatgaaatactgttgcatattcttccaccgtaaaaagttccgtcactttgacacttccaggtttgcacacgcggttcagatcattccgctcgagatcaacgatcataagaagttcactcttatccttctctgaatttttgagttcatttctcataaggagatcctcttccagagtctcacctctttttcgcgttcccttgatcggacgtgtattcacatgtcccttcttcatcttaaggaatcgctccggtgatgcacagacaatctgaaaatcaccgtaatccatatagccgccaaatggtgacggattgttttctctcaaatcataaaaaacatccagtggttttttgttgctctttacctcaagctgctgcgtcatatttgtgatatagatatcaccttcgatgatatatcgaatcatctcatcaacagcctgtttgtattcttcttttttaaaatttggtgttatttctatattaaatgatccgtctgcgacctgttctttttctaataatacttctgtcagacgcttttcaacagatttgatcagtttctctgcatcttctgtaactccattggccaccagaaatgttttcttctcatgacaatcctctatgatatacatgtcataaaaaacaagtactgcatccggaatcgttaccagattttccttatgagatggtatttccattaatttccgcccgtattcatacgaaaaatatccgattgcccctgatagcattggaagcccgcttttgttctgatctttatgctcagacagatattttttgagatattcctcaaatgagagttccgataccttctgctcatttataaaaaatccatgatcatcttttactaatttgagatatggccgcattcctatgattgaatatcttccaagcccgttcacaagagatgaatccagaaatacacagtccttttcatccgaaaaatatttgaacagttctgctgctgatctgtgtggagtcaatttttttatcacgcggtttatattatacatctatttttcctctctgtccatttttcgaaacatttctataaatttttcttatatatttcatagattttttattcatttttgttgaatttctctgcaatacaacagaaattttctaacaactcatgaccatattccgtcaggactgcttccggatgaaactgtacgccataaagagggatttctctgtgcgagattcccattaccgctccatcttcagccacagcatctacccggtattcttccggaatactgtcttctctcacaaccagtgaatgatacctggttactttaaatttctccggcagtccttcaaataatcccgttccattatttcggatccctgtcacctttccatgcattggacggctccctttctctacaacagctccacagcaatgtcccaacacctgatgtcccagacagacacctaagatcgggatctttccctgaaaccatttcactgtttctacacatcgcacagcatcccatggacgtttcggtccgggcgaaagaatgattccttccggctgcatcttttctatttcttctatattaatctgatcacttctcctgaccatgatctcccttcccaactcctcaaaatacgctttcagattgtaaacaaacgaatcataattatcgatcatcaaaaacatgtttttcctccctctccgtgcaaaacacgtataaaaaaagagataactcgcgtgtgtatccatacacacagtcgttatccctgtcggtccgtaatctgtgaatctttatcgttttttatatttctttttgaaagatacctctatgctatcatgtctgccaattctcgtcaatatatattagaaatgaatatttttttcaacaaattaccccttttatatcgaatacatctatgctatactgtacgggaaatgaatgatatgcaaaataggatcatatgcgtcaagtgttcagcgaatggggagttgtcgccgaaacgaaaagtccgtcttacggtatatgatccgcacccgttgcaacaatataagaggatatctcatattgtgtagggatacgtttttcgacatacgttctatcacaattggagatatctttttcactttaacacactatcagctcgacaaaaaaaagacaatctccacagtacacgatatcatgtttaacaggaggttgtttttttaatggtagataaacagaaagtagaacaggcaatccgtctccttcttgaaggaatcggtgaagacacagaacgtgaaggtctcaaagatactccggaccgaattgcacgtatgtgtatggaaatttatggtggactggatgaagaagcggatcatcatcttgccaaacagtttgaagtagaaaataacgaaatggtactggaaaaagatattactttctattctatgtgtgaacatcatctgatgcctttttatggcaaagctcatgtagcttatattccaaatggcaaagtgaccggactcagtaaacttgcccgtactgttgatgtctatgcaagaagaccgcaaattcaggaacgcctgactgtacagattgccgatgcactggaacgtactctgaatcctaaggggattatggtaatgctggaagcggaacacacctgcatgaccatgcgtggaatcaaaaaaccaggaagtaaaacgattactaccgttacccgtggtgatttcaagacagaccgtgaacttcagaaacagttcctctccatggtaaaagactgatgcataccgatatgacaagagtaaatgctatctggcagcatcctctctatcagcaaaatctgaaagatcttatacaccttgaagctgaccgtatcttctgccgtcatacaccggaacattttctggatgtcgcaagacttgcttacatatttgcactggaacgaggacttgactgctcccgtgaactgatctactgcactgcacttctccatgatattggtcgcgtcagacagtatatggatggtaccccgcatgacgaagccggtgtacagattgctgaacagattttatctgatcttgctttttcttctgcagaaaaagagcagattctgaccgcgatcggggaacatcgttcctcaaaagaggaaacttcttccctgagccggattctttatgaagcagataaaaaatcccgtatgtgttttctctgtcctgcagaaaaagaatgctactgggatctttcaaaaaaaaatatgatgattcaatattaaaaggagaatcttagatcatgaaaatcggaaatcgtgaatttgatgtaaaaaacagaacttatattatgggcatcctgaacgtgaccccggattctttttctgatggtggcaaatggaatactatggatcatgctctgatgcatgcagaagctatgatcaaagacggtgctgatattctggatgtcggcggtgaatccacacgtccggggcatactccggtcagtgcagaagaagaagcagcacgtgtcgttccggtcatcgaagcacttcgcaaacgttttgatgtaccgatctctgtagatacttacaagggaagtgttgcagatgcagctgtccaggcaggtgccgatctggtcaacgatgtctgggggctcaaatatgatccggacatggccggtgtcatcgccaaacatgatgtagcctgctgtcttatgcacaacaaagccaacacagaatacaataactttctcatagatatgcttgctgaaacacaggaatgtgtcaatattgcccgaggagccggaatcaaagacgaacgaatcattcttgatccgggcgttggtttcggcaaaacatatgaaatgaatctggaaaccatgaatcatctggaactttttcagcatctcggattcccggtcctgctcggaacctcccgtaagtccatgattggtcttactctggatcttccggttgatcagcgtgtagaaggcactgttgccacttctgtcatcggtgtcatgaaaggctgtgcttttgtccgcgtacatgatatcaaagaaaacaaacgtgctatccttatgactgaagcaattcttggaaggaatataaaataaatggataagattgagatcaaaaacctggagatttttgcaaaccatggagttttcccggaggaaaatgttctcggccagaaattcgttatttctgccactctttacacggatacccgaaaagcaggtctgaccgatgaactgactgcttctattcattatggagaagtcagccatatgatcaccaaattcacaaaagagcatacttataaacttctggaggcacttgcagaaaatctctgccaaatgctgcttcaagagcttccgcttctcaaaatgatcactctgcgtgttgaaaagccatgggctccggtcgctctcccactcgaaacggttgctgtggagatcacccgcggatggcatactgcctatgtagcctttggttccaaccttggggacaaaaagaagttcctggatgatggcattcagggactccgtactactccttcctgtgaagtagaagctgtatctgaatatttagttacagaaccttatggtggtgtggaacaggatgaatttctgaatggtgttctgaaactccgtacgctgctcacgccggaagaacttctggaccgtcttcacgaactggaggcggccgcaaacagagaacgtatcattcactggggaccgcgtactcttgatctggatattctgttctatgataatgagatcatagacactccggatcttcatattccacatattgatatggaaaatcgtgattttgtcctgaagccaatggatgagattgctccttattacagacatcctgtattaaacaagaccattcatcagcttcttaatgaactccttgcaaaagataatcagtaacttttcattcaaaaaaacttctgagtcccgggatcatactcccaggctcagaagtttttttgcttcttcaagacgttcataaaattgctcataaaaatctctgttttcttcatatgattttgtataaaaacggctgagcacatacatattcagatttttgatcagatccgcatcttccgtctggtaaaacacttcctgtacatccagaagaaactgatgccaatcccatacaaatttttcgtattgtctgaggtccggtgtgtcgatccatttttttaccttgatcttggaacggtttttctttgcacattcatggatctgaatgatatatttaaatccatcttccgtataatatcttcccagtggaaacaaccggcagaatccaggacgaatctcatgtatggagcatctgccttcctgattcaggaaaacgcatttttcttctgttccgcgcattgccagatgtggcagaacattgccatcagaaatcccaagttccaacacactcccaatcagttcttccggtattttccggagacctctgctcaatcgacagacatcatacggatccagaaggacagaatctcccatccctgtacagcagtcatgacagcctttgcagtcctgacaatctgctttgaccatatcattcgcatcatataatcttccatctgaaatttcttccagtgtcacttctcttctcatagattttcctctttttacttatagtatttatgcccttgctatttcttatgatacaggactataatagggaatgtcaatctgttgctgccaataataaccaacagcaacacaataatataataaaaaacggaggaaacctaaaaatgcgatctctcgcaatctatctgaaaaattacaggaaagaaagcattcttgcccctttcttcaaatttctggaagttgtgtttgatctgcttgtcccggtagtcattgcgcagatcattgatgtaggtatcactggaaatgatcgcccgtatatcatcgagcgattttttattctggtactcatggcagctgccggactcgcagtcagcatcaccgcccagttttttgcagctaaggctagtgtaggatttgccacagaactgagacaggccgtttacgaccatgtgcagaagctttcttacacagaacttgatactcttggaacagatactctgatcacccgtcttacagatgatatcaatcaggtacagaacggtgtaaatatgggcctgcgccttcttcttcgaagtccttttatcgtattgggttccatggtcatggcctttacgatcaacacacgttgtgcattgatctttgttgttgctattccggtgcttttcctggttgtatttgtgatcatgtacctgagtattccgctttttggcaaggtacaggcacgtctggacgcagttacaggactaacccgtgaaaacctgaccggtgtacgtgtcatccgcgctttttgtcgcgaagaagaagccgtccgtgaatttgatgccagcaatgctcagcttacaaagctgaacgaatttgtcggaaagctgtctgctcttctaaatccggtaacttatgtactgatcaatatcgcaacagtcattctgatcaataatgcaggactccaggtcaatctcggaaatatgcagcagggacaggtcgttgctctttataactatatggctcagatgatcgttgaactcattaaacttgcttctctgatcattacactaaacaaatctgccgcatgtgcaaaccgtgttgccgatattctcaaagtaaaatcttccatgaatcatccggtttctactgcctccactgcagtttgcggcgaaaacgcagtcgaattccatgatgttacttttacttatgcagaatcaggcgcacccagcctttccaatatcagcttttctgtcaaaagaggccagactgttggaatcatcggaggtaccggaagcggtaaatccaccctggtcaacctgattgcccgtttttatgatgcgaccagcggaactatacagatagacgggcaaaatatccagaactacagccagcatgaccttcgtgaaaagatcggtgttgttccacaacgcgctgtactttttaaaggatccatccgcgaaaacatgaaatggggacgtgagaatgcaacagatgaagaaatctgggatgcactcacgaccgcacaggctcgtgaaattgtagaaaacaaagatggacagcttgatttcaaattggaacagaatggacgaaatctttccggcggtcagcgtcagcgtcttactatcgcacgtgccgttgtaaagaaaccggaatttctgattcttgacgacagtgccagtgctctggattttgcaacagatgctgcacttcgcagatctctccatcagctcagtggaaatgttaccaccttcctggtgtcccagcgtgctgcaagtatccgtcaggcagatctgatccttgttctggatgacggtgagcttgttggaaaaggcattcacgatgaccttatccgcacctgcgatacgtaccgcgaaatctatttctcccagttcccggaagaacgtgaaaaatacaatacatcaaatacagccgtatccgttaatgcttcggaggtgaccttatgagcaaacagaacaaacagcagacaaatacgaccagcatggaaaccctctggaaagtactccgctttatcggaaaataccgttttcttctggtcctgagcattattctggcagctgtatctgtcatcctgcagttatatgtaccagtacttttcggtaatgcgattgaccaggtagttgccaaacgtgaagttaatttccgtatgatgtggtattatctcagccggattcttgtgatgatcatcgtttccagtgttgctacctggattatgaatatcattaacaaccgtataaccttccgtacggtaaaggatatccgtgcaaaagcgatccgtcatattcaggaacttccgctctcctatctggacagccacagcaccggtgatatcataagccgcgtcattgctgataccgatattctttcggatggtcttctgcttggattcacacagcttttctcaggaatcgttacgatcatcggaactctgcttttcatgttttctaagaatatctggatcactttgatggtcattgttctgactccgctcagtttctttgttgcaaaatttatttcctcacgttccttccatatgttccggaagcagagtgatgcacgtggccgtcagaccgcacttatcgaagaaatgattggaaatcagaagatcgtacaggccttcggatacgaagataaatcatctggacgttttgccctgatcaatgaagaattaaaagaatgcagtcagaaagcggtcttttacagtagcctgaccaatccgtccacacgttttgtcaataatgtcatttatgcaggtgttgccctggccggtgcttttatgattcctggcggctccctaactgttggtggtctgtccgtacttcttgcttatgcaaatcagtacatgaaaccattcaatgatatcagttctgtcatcacagagcttcagaatgcacttgcatgcgcggccagaatctttgctcttctggaagaagaaccggaaagtgctgattccaaggacaccatcactgatgtcagaggtgaagtcaacatcgataacgtttgtttccgctacgttccggacaaaaaactgattgaaaatttcaacctgcatgcagaaccaggcaagcgtatcgcaatcgtcggaccaactggctgtggaaaaacaacctttatcaacctgctgatgcgattctatgatgtgaccagcggtacaatctcgattgatggtcacccgatcaatgaaatttcccgtcattctctgcgtagcagctttggcatggtgcttcaggacacctggatcaaaaacggcactgtccgcgaaaatctcaacatcggtaagccagatgcaaccgatgaagaaattatcgaagcagccagacgttctcacagctgggaatttatccgccgtcttccaaatggcctggacacacgcttaaaagaagacagtctgagccagggtgaaaaacagcttctttgtatcacccgtgtcatgctctgtctgcctccaatgctgatactggatgaagccacttccagtatcgatacccgaactgaactgatggttcaggaagcttttgaccgtcttatggagggacgtacaagctttatcgtagcgcatcgtctttctacgattcgaaatgcagatgagattcttgtcatgaaagacggaagtatcgtcgaacagggatcgcatgatgaacttatggcaaagggcggattctatcaaaatctgtacaacagtcagtttgtcaaagtagctgaataatattctctcaaacataaaaatccgtcgaaacagttttatgagttttcatacattctgtatcgacggatttttttatttacaagtatcttcttttctggagatcagttctgcttctgtgcagccagatattcctcagtcaatgctactgcatcacgaatacaatccggacaactgcgaagtacttttcctgtttccacacctttcagttccctgcaaagataagaaccattctgttcctggaacttctttacatattcttttacctttctgtaggtatcaccttttgtcagtctgcctttttccggttctccgacactgttttccagtccgatgatcatcatcattcctgaaagtgctccacatacttccatcattcccattccaagtccgaagccttctgcgatccggaacatctcttcttccgctacaccaaattcctgacaaaacgaacaggcaactgcctgtgcacagttatatcccttatcatgaaatgcaattgccatatctgcttttgtactcattttctttcctcctgcatactttatactttcgtttgttttttatcataacagaaatattacaatatatctacattttttataacaacatactgtttattatattgaataatatttttataaatggtataattatttttaatcatatagttaaaggacatattcttatgggcataacaaatgtgctgtacaatcgatcggaatttcttgaaaaagctcaggaattccttgatgcatgcgaatcatctggctggtgtatcatttccatcgacatcgaacgttttaaattatttaataactggtacggacaggaagcaggggatattctgcttcagaatatcagtcagtacctgcttcgtgtacagcagatgaaaggatatctggctggctatttcggtggagatcatttctttatgtatattcctgatgacgagcaactgatcaatctgatttacaaaacaattcgcagttatattggcatccacagtcagaacgaggggtttcttccaatcatcggtatctaccccattacagagaagcatccggatacagcgaccatgtgtaacaatgcacagctcgctgcttccgagatcaagggaaattttaataaacggatctgttatttcacaaatgagatcattgatcagctggaaaaagaacaacagatgctccacgacgtaaaagtcggtctggaaaacaaagaatttactttctatctgcagcccaaatgcaacagtatcactggtgcaatcgtcagtatggaagctctctcccgctggatcagtccttcccgtggttttgtttctccaggagaatttattccatttctcgagaataacggtatgatcactgcactggatacttatatctgggatgcagtctgccagactctggcctattggaaaaaaaatcatctttatgttgttcctatctccatcaatgtctctgtagctgacattgaaacgatcaatgttcctgaatttcttcaggatcttatcataaaatatggactgacacccgaaatgctccttgtggagattactgagactgcattttccgaaaataatatcattgtaagaaaaacgattgatcagcttcatcagtatggtttctgtattcttatggatgattttggaagtggttactcttctcttaatatgctcaaggatgccaatgtcgatattttgaaacttgatatgaaatttattgaaatgaatccagaaaaccgccagaaaggtattcagatcattaattctgttgttaacatggcacacaaactggagcttcctattattgcagaaggtgtggaaactccggagcagattgagatgcttcattccatgaactgtgtttatgcgcagggatactttttcttcaaaccaatgccagtcgcagatgccgaagatcttctcagtaatgttcctcatgaacactataatcatgcccacaaagctgtttcagatgatactactgtgacagaaccaaaatcatccgtagaacttcttcatgaaacaacggttacacattccatttttaagatccttgcggaaaatttcctgcttcttgcaagactgaatctcagcaatgcagaatacgaaatcctcaaaagagattatcggcttcatggcaaggaacttgaactggagcataattttgaattatacaatcgtcgtattctcaacgaaaacctgattcatcccgacgacgtagaattataccgttcaagaatcacactctcttcactgcaggacattttctttggtggccataaacagctcacctatcagttccgccgttgtttggacaatgattatatctctacgactatggaatttctcgccggcagcaaatgtgatgcacagaatccatggattgttgttatcattcgcgaaaaaacagtctgagacgacattatctgaaaacctgtccgattttttgtgcatttgtctgtacaattagaattgtatcttgacagtccgcggtaaaaagtgctattttaaccttgaaattttaaaaatcatatgacgaggtgcaaagacatgcaggaattaaaacctattaaagaaggtaaagtacgtgagatctatgataacggagacagtttgatcatggtagcaactgaccgtatcagctgttttgatgttatccttaacaatgaagtaaccaaaaaaggaactgtactgacacagatgtccaagttctggtttgatctgaccgaggacattctgcctaaccacatgatttctgttgatgtaaaagacatgcctgaatttttccagcaagagaaatataccggaaaatctatgatgtgccgcaaactgaacatgcttccaattgaatgtatcgttcgtggttatattacaggcagcggatggaagagctatcaggaaaatggcactgtctgcggaatcactcttcctgaaggcttaaaagaatccgacaagcttcctgagcctatttacaccccgtcaaccaaagccgagattggtgatcatgatgaaaatatctcttttgagcagagtattgaccatctcgaaaaatatttccctggcagaggacgcgaacttgcagaaaaacttcgcgataatacgattgctctttacaaaaaatgcgctgaatatgcattaagtaaaggcattatcattgcagataccaaatttgaattcggcctggatgaagacggtaatatggtaatcggtgatgaaatgctgacacctgacagctcccgtttctggccggcagaaggatatgaaccaggccatggacagccttctttcgacaaacagtttgcacgtgactggctgacttctcatcctggaaacgactggacactaccacaggaaatcgtagacaaaactatcgaaaaatatctgcaggcatacaaaatgcttacaggcaaagatctcgactaatacaacttaaaggagtgaattttacgagtggatgcaagtgacacttaccagctaattattctgatcatattactggcgttatccgcatttttttcatcaaatgaaactgctcttatggcagtcaacaaaataaggctgcgcgcccttgccgatgaaggcaacaaacgtgctgcaaaggttctggacattgttgagaatcatacccccaaaatgctcagcgctattctgattggaaataaccttgttaatatcaccgcctcctctcttgccacttcactggcatacagttttggcggatacatggtgagtattgccacagctgcccttactgtagccatccttatatttggtgaaatcacacctaagaattatgctacattgaatgcagaaaaaatcaccctgcgctacattcctattcttagtttttttatgatgatcatgactccatttatttttattatcaatatggtgtcacgtgtattcatgaaattgcttcgtgtggatccggatgctgctaataaggctatgacagaagaagaacttcgtacgatcgtagatgtcagccatgaagatggtgttatcgaatctgacgaaaagaaaatgatctacaatgtattcgatctgggagatgcagatgccaaagatattatggttccaagagtcaatgtatcttttgcggatgttgattctacttatgatgaactgattgatatttttcgtgaggatcgttttacgcgtcttcctgtctatgaaaatacacaagacaatatcgttggtatcatcaacatgaaggatcttcttttgtatgattcaaccaagccttttaatatccgtgattatctccgcaagccacattttacttatgaatacaaggatatttctgaacttctggtcgaaatgcgtgaatctactttcaacatcgccattgttcttgatgaatatggtgaaatgaccggacttatcaccctggaggacattctcgaagaaatcgttggagaaattcatgatgaatacgatgaaagcgaaaatgaactgatcaaaaagctttccgaccgtgaatatatcgtagaaggatccatgagtcttgatgacgtaaatgatcatctcggcactcatcttgattctgaagattacgattctctgggtggtctcatcattgaacatctggatcgtcttccggtcgcaggtgaccaggttattacagatgatcatatccgcctggtagttgagaagctggataaaaaccgcattgaaagtgtacgtgtgattcttcctgaagcaactgaggaaacagaatccggtgattctgagtcttcaaaagaagcataaaaaagaagtactgttttgatttcttcagaacagtgcttccttttttattttatcagcatttgtgttttatgcttctttgcttcatacagtcgttcatctgccctggacaatgtatcttccgtggaaatttttttatccctgcacattacaaaaatacctgccgatacagtcacataataagcgttttcacgatctccatccatgcttccttcagccgctccagtgaatatcctgcattggcaggactcgttgacggaagtttctgtgctttgattccattcaccgggtaaatgtatttatcatacaattcaaaagcttttccaccatttgtataaattgcccggatatctgccgtcgcaagaatttccgacagatcattcggaatcacctcatgaatactggcatctgaagagccttcaatctcacagctctgaatcacatcccatacagcaatatgattcgccagaagcatctccttcttctcctcaattgtctgaggcacttcatatcccagaatcccggcaagtactttccaaaaacggttttgcttatggccataaaaaaattgctgttctctcgattttacagatggaaaactccccagtatcaggatacgggaattcttgtcatatatgggtgctattgtgtgttttatcataataacctctttctccgctcacattagaaccattttactgccattagtaaagtgatctattcctctcgaagttctgcattcttattttgcctacattataaatatctgtgttcttttagtcaatccgattatgtcatgttatattttttacttcactttctggttccactccacaccattcgtatctgtccatgtatcttttctgttaaaaataacactgtccatttctatcttctttcaattattgcttaatagtttaatatttattatgaaaaagcaccctcgaaactgtccaggcttttcaagagtgcttttccggttacttggtcagctaaaaattaaagagcaatctcacaatccggttctaccttcttgcaagcctttaaaacatctttcataacggttcccggctcttttccttcctcaaactccacaatcatcttctgtgtcataaagtttacggttgctgctgcagacattatcataatcgaaaaagaggtagaacatatgacacaaattacattgccacataatcatggcgaatcagctgatgagctgttttctctgcttcctgctccacaagaatttcagacatctgcagaactattcggattactcagtgatgaaagcagactgcgtattttttggattttatgtcactatgaagaatgcgtaatcaacctgtcttcccttgttggtatgagcagtcctgctgtatctcatcatctaagacaattaaaaacccgacggctgattgtcagccatcggagtggaaaggaagtctattataaagctgctgataccccacaggttcacactctgcatagctgccttgaaagattaatttccttatccgattccacagagcatcaaacggaggtatcaaatgacacggaaacacgataaaaatacggaagatattttgaaagatattccaaatggaaaaatcatcataaaccgccataacagtacacatgaaaacactattttcaataaggattttcgctattgctccgatggaaggggactagtagatacttattctgtttttcccggaattgaactttcttttaattattactatgcaaattgttttgaatttcagcatagacctgtccactctgctatgcagatcaatcactgccgaagtggaagaatgggctggaaaatgcaggatcaatccacaatatatttgggccccggagatttatctctccacacactgcattcatgtgcggattctgccatgaacctgccattaggatattatcaaggtgtatccgtcttcattgatttgaatgcgctaactgctacaccaccagacattctttctgaagcaggcatcaacggaaataacctctacgcaaaattttgtgaacaagcagggcatactgctataccagccagcgagaaaatcgaacatattttttcagaattatatgatttgccagaaagaatgtacttaccttatttcaaattaaaagttcaagagttgctgttgtttttagatatgctggatttagaaaatacaaaaagattgaaccagtatgtttccggacaggtggaaactatcaaagaaattcacagtctgatgacatccgacctaaaacgccactatactattgaagagttgtcaaaacagtacctgatgaacaccactactttgaaatccgttttcaaagcagtctatggaatgcccatcgcttcttacatgaaagaataccgtatgaagtcgacatcgaatatgctgttgcaggaagataaatctatttcggaaattgccgccgctgtgggatataaaagccaaagtaaatttacatcggctttccgagatatatttcagatattacctactgcatatcagaaactgtatcgtaatcaataattttaatgcaaaactgcacccacaatatccctgagtgcagttttgtgtcaatcaatattctaatgtttctccattaagtggaatatcaagaacaagtatcctatacaaatgcactttcctcttttgctttccgcaaatcttttaacactgttcctatatctcccaaaatagcaatccccttatcttcaatgaattccggcaaaaactgatattctgaatttacggagatataatatgcatctttcaagctgtttgtcagttcccaaaacggttcctgtataaacatcggtgtcatgcgccctactccaagttctatcaagagaatttttctatctttgttcttttgaatgtattttgagattttctcatattcttcttcgtattttttcccttgcagaaaattcccatatcctcttacccacggaaacatttccgcaccacaatgagggcagcgaggaatcagttcatccggcaccattgtcccctctcccatagccgcaatcatatctgccacaggttgtacggcatcccatgtttcatcctgacaacactgggaacactggaagaaacgatgatctccctgaatctcactgaccttttcttccggataaatctttacaaactgtgtatcctgattagtcgttaagatatgaaaatcctttccctgcaaaattctatccaaatccagatatggctctctgataggagcattttgtgtagtatttaaaaaggttgccacatatccccagtgttcatttcttgtagaaaaccgatgcatcattccgctaaaagcacctttgaatccatacttatctgcaaattttccaaaatgttcacgaaaagaaggggtatcactataataaaagtcaccacctccagccgctgataaaccggatgctccgcctactatgatacactctgcctcctgcactctgcgaacaaattcctgaatctgttcctcataaggaagtggtttttgtttgctcaacactacagcagtaccgccggatgcataggtactatagtgtctggaatagttcatttgtgttttcattaccaaattttcgtaacagctcatttttttcattctcctatctcacaactgtaatatctttaaccactttacttagtctatccttccttttctgatttcctttaacgctaccataagattaccatccacaccgatggatttttctttgatttcctctggaatgtaaatttcgcccttgttaaatgtgatatatcttgcctgtggttctactgctgcaagatgcatcaaaggagctttaatcatctgatttctccaaccaatgccaaattccagaattaccagcttctttccatgtaacttctgaataaattcttgatagcgggcagccttttccttccaatttttcgttcctgtaaacgaggacatctcaccccaatttacttccatatctccaccgcattttgggcatttcggcagtaactctttgggtactcttccgtttacttcctcttctgtcatggcgagaactgctttttgattaggatagacctcgtcatgacatctgttcttgcaccgcatctgggttagtttcccttccatttcaaaaacacggtctgcctcaaaacctgccggcacaaaatgatcctccgcattggaagttactacgaaatattctttatcctttactagggcatagatgtttttcataatctcactcggctcatcctgcatagcttttgccttaacaagtctgcttacaaacgcccacttttcttctaccttcattggcactgaaaatccgtgtaaaacacaacgcagtccgtatttttctctgaaatcgcccatattttcctgaaaccatgcgtcatcagcaaaaatattatatccctctgcgatagacaaaccattactggctccaatcaaaataccatctgcttctttgatgatttgacttatctcttgatatacattcatcttcatcacatttcctttcccgctatgttttcttttaaatcccgcagggtttctgccaaatctcctgctatataaatgcctttgtcttttatatgttctggagttgaggatttcttctgattcagacaggcataaaacaccttttcatttttgtatgtcatttcccaaaatggaagtttaataatactgggtgtcatctcaccaacccccagctccagcagtacaacattcttatctgttccattcatgagatatttttttaggaaattctcatatcgccttacaccttccctccagtctttcccctccaaaaatgtatcatcccttacccagggaaccataattctcccgcactcattacatcttggcagaagctcggaagtaacacgcagctcccggatattttcgttcatcctgcgaatcatttctacattggaataaatttggtcatggcaaggctgactgcattgaacatagccgctgttaccttgataatcgcaaatcctttctttctgaaaaatccgttcaaactgcatatctatattggttgttaaaacaaatacttctttttccgccacaataccacgcaggtcatagtatggctgtcctgtaggtgcatcccacatactttgtatgtaacgtgcataatatgcccactgttgttccggcgatgaataacagtagtaaaaaccgtcaaagggagatttcagtccataccactccttgaaatcttgtaaacattcctccatatagggtagccaatgataatggttatatcccgccgcactggaaagaccagaaccaccgcctatcaaaacggcatctgcctgacggattttttctgccagaaaactgacttgttcctccttttgcatacaccactttatctccttttttatatcagattccacactttttattttgcttgacttttattcttttacttgttaaaattaaatttacatcaagtattaaagtcatattatcatgtaagtttaaaaattgcaagaagaaaattcgaggtgacaaatgaaatattccacaaagcttagtgacaccattcatattcttatatttattgctcttggagatgacgaacaactctccagcacaaaaattgcagaaagtatcaagacaaacccggcttatgtcagacaacttatggcaaccctgaaaaatgcaggcattgttgtcaacacacaaggtcatgcgaatgccgctcttgcaaaatcggcagataaaatcaatatgtatgacatctaccgagccgtagagggcgataagccgctgcttcacctggacacagataccaatccggattgtggaatcggtatcaacattcaattcgctattggggacttctatcatgaaattcaaaatatggtagatgaaaaaatgaaatccattacattgcaggatattattgatcggtattattttaaaatcagaaaagttaaaaaactttaactaatcaagaatagcaagcactgcctgtgtcatgacacagacgaaattccccacactttcctatcgtctgtgtggttaaattttcatagggaaccttgggtagttacacccaaaattgaattaaacacgaaacagactgttgtaaaaaccgaacattttacagcagtttttttgtacccatttttaggaaggacgtgactcaatggcaaacagaaaccgcaccaatccggtgcaattttatctcagcgatgatgagcagtacattctcactaccaaattcaatttaattaaccagtaggaaatgttgcatgattaatctgctgttttggctgccttgatacttcttaggttgacggctagatacgcattagagatgtctccatccaaatgctgttctagcaagggatttttcccttgaacccatcatttatgatatatggtggcgcttttcgcccccaaatagtgaaagtgggggcactttctgcccccactcaggaaatgttgctaaaatactgtttagatttatcatacatacaaaatggaagttatctatttctcctcttcgttaagacctagttcattacatattacttgctatccctgataccttattctttctaccagcgtttcctttttcagattactgcttaaaacgcaggaaagtacaatctgcaacagaccgaccaaaaaaatcataataaaaattggtacgattggaacatgatagatattcattccaaatattccattatgttttgcataggaaaaaagtgcatagccgagcggcagaccaatgatcaaagctacgcatatggtaccaaccgtaaacatcagtccctgtaactgcagacataaatttaattgtttatttgtcatacccacagcctgtaatacaccatattcctgcttttttgtcgtaatattcatgattatggtgtttgccatattcataaaaccgatgagtcctacaaccgccataaacagatagcagccaagcttcatcatacggcttgcgtattctgcagattgtaactgtgcatgataggtatccatttttatatgcgaagtattagaaatcaaagtattcagactctgttccacagatgcaacatcttttttatcacagtccacccacagatagccataggctgtccccctcggattcatggaacggtatacaccttccggaatgacaagataattgtccgcgcttacaaaggatcctgcaatctttccctgataggtataggtttcacttccattctcaaaatcaaatgcaatggattcacccggagcatatccatcttgttccatccacgccgaccagccaaagaaaatttcaccattctttaccgcctgatcatagtccatagagccaatatccccgtcctggcgcataaaatcaaaatcatttttactcacaatatcagccggaaatcttgttccgttcagatttacagagacaatctctctcgtcatgacatctgtcactcctggaatgcttttgatttcttcaatcattgaatcattcaatggattatccgtcagaatcgtatccagattattctccggatatctttcatcgtactcagcagaatagtcaagctgcagttcaaattgtccatgattaacggaaagacgtgcttcatgctccgtatcaatatttcctacataattagagataatcacaaacaatgcgcaggaaagccccagtgtgaggatggtaccaatggttctttttggattacccgttatatttgccattgccatagaaaacacggtgacattttttctgccatttcgttttccttttttgtgtgtttctgcattttctaaataccgtgttgcttcgataggtgaaatccgtgaaacaattttcattggtttacgcagcgccaaagcaacggtaaaaaatgacacgaaaatacatagaagcataacaggcagggaaaacagtggcatctgctgattttggactcccatagagccagtttcggttgatacaaggtttccctgttctaccagccagttaaaaccgcattttgcaatcagaaaaccaagaagcaatccaactggtattgaagaaattgtcaaaaacataccctctctgaagatcagttgtttcatctgcttttttgtcgctcccagagccttgatttttccatactcctgtatcttgttggcaataccgacctgaaaaatattataaatgaccacaacagagaaaagtacaattgcaagaatcaaaaccccgcataccgcaatcgtttcataactcggctgcaagacccattgcaaatagagatcattgactataacgtttttttcttcaatcccacaagctgctgcaatctgctttataaccgaatcaatattattcatagatacatttgcagaatcatttaaagtaaaataaatattatactgtctgtcattctctgcgacgtgctcatcataaaactcctgtgacccgaaagcaacataagatgcctcgatggtatactcatcccgatcatataggattccgctgacaacaaattcttccggcttatattctgactgcatccctgcgcggtaatccaatgtaaccgtatctccgatctttacatcaccataccccattgcacgaaaaaatgctcttcctgcggcaatttcctgcattttttccggatactttccttccttcaactcatattctttattataaggaagcatttttcttgcagtctcatccatgcagacaaacccgcctttttcattgccttttatgataccttcggtgcacatagtgcctgtagcatctatttccgcacggcggtttacttcttttaactgcgatccgtctgcggaaacaaacagaccataattgcttccatatgatcctgccgcctgacttttctgtaaatgaattaccccatttcccacagtactgatgataacaagcagcatcgtggtcagacagattgccatcatgatcagtatacttcttgtcctgttccttttgtcattgctatatgcaatcctgcttattgtcttcatctgaaatccaccacctgtccgtcctcaatcaccagaatacggtcagcgacctgtgcaatttcgtcatcatgggtaatcattacaattgtctgcccatatttttttgctgtcatcttaagcagagcgattacctcatcactggtcttagaatcaagatttcctgtcggctcatctgcaaatataatttccggacgattcaccagtgctcttgcaattgctactctctgctgctgtcctccggataactgatttggcagattataaatccggttttcaatccccagagttgcaataatatcatttacatatgcttcatccacttttcttccatccagccccagtggcagaacaatattttcccagacattaacagatgaaaccagattaaatgcctgaaaaacaaatccgatttttcttctgcggaaaacagcaagggcatcttccttcatcctgtataaatctttccctgctaaagtaacactgccttttgtcggggtgtctagccctccaagcatatgaagtaatgtacttttaccggaacctgactttccaacaattgcgacaaattctccctgctcaatctgaatgtccacctaattgaccgctttgacctgattctcacctgcgccataaaacttacaaagctgcttggtttctaatatcacactcatgtgttacctccttttcatcctacatccaaattgtatcagggcaatctttcatttcactttcaaaaaacgagcagaagtcttacagaattgtaagatttctgctcacttaaaatttaaccaacatatggtaattgaatcacaaacgtgcttccttttttctttttgccggaggttaccgtaatcgtacctgcgtgtttttcgataatttctctcgatagaaaaagtccgattcctgtaccactcttttccatgacctccttggaacttcctctgtaaaatcgttgaaaaattttgtgatactcattctgcggaataccaattccctgatcctcaatttccattcttacaagatagtttcttttttgtaaccggataaatatttttgaaccacacggactgtacttgaccgcattatccagaacgttgatcacagcttcaccaagccaccttttatcctgcataatcgtgcatgtttccagctctttttcatagtcaaaaacgaattcaatttctttctcatccgctttaggataagtgcggttcacagcagatatgacagtatccataagcggaagttttttcttattaatctgaatcagtccagtttccatcttggatatttcaagaagcgactgcaataatgtctccagtccatccagagcactccgacaacggatacgaaactcctcctgttctgtggcacttaagtcattctgcatcagcacactaaaacatgtatccaaagctgcaaccggtgtctttaactggtgagaaatatcagaaaccatttctttcgtgttctccttttctgcccttgcttcttcctttatcaactgaatatgatgtccgattgcttcaagctggtcattcaatttttccagttctgcatgattttccgttttcagtaaatcatcaaatttattttcacggaatctgatcagaatttcttccaactggtctaaaattttctgatgacacgcatcttcttttttcttccaataaagtaaaaaagtcaaaagaagcacgcatatcacagtacttacagcaccggtcaccataacctgatgccggaattgcgaataaaatgcattccctttattcccccagtatccatattgctccaataatcgccttccctgttcgttagtttcaatatccttatccttaagcaattccgaaacagcatccagcccggaaaattcttcctttgcagcaatctctgtcataagattcattttatatttataatcttcataaaacacatacgtggtaaagcaatttaatattgcaaacaataatatgacaggtaataccaaggaaatcactactgtaatcttcttgcgatatctctttgtcactgccttacctcctgattccatatatacccaagacctctgatattctttatatagaccggtgcagccggattgtcttcgattttctcacggagtcttctgatattgacagcgattgtattttcatccacaaaatccccttccagatcaaacacattttccaatatttgtgtttttgaaagaatctgtttcggattctgaagaaaaaaagtcagcattttcaactccgtttttgtcagactgatttcacgactctttatcaggactttcatttctcctgcgataaatacgatatctcccgaaatcatctttccggcttccgttttctcctgtctgcggcggaaatgtgcttctattttcaaaagaagtaccgaaagactaaacggctttgtaatataatcatctgcccctgcttcatatcccatgacctgatccatctcctgatctagtgctgtaagacaaataatgtatgtattataattgcatctcatccaccttacaaattccagtccattcccatccggaagattcacatcacaaatggtaacatccacattgttatcacttgcaattcttttcgcttttttcactgattctgctgaaaaaacctcatatccggattttttcagtgagaatgtaattccacgatttaaattttcatcatcttcaaccacaagtatacctggcatagcatatgcacctctctttattaactatatatatttaatatcagagtactgcttcttcaattctctcatcgtttgtatctccaaaagataaaacaatggaactatcgtcagcactgttatcctctgaaaggagtcgtcaaatatgcttttgctttttcaatgccggaagtgtggcaagttcttctgtcggagtaagcattatacagcgtctgtttccaatatatgctgtgtgaaaatcataactccctgcaatataaacaggcaaagaatcctgatgattccctgcttcatattttatagaaattccgaatacgcttgtaaggatatttcttattccccttttaacttaatttctttcattttaacatacttccatataatgtacaaattgatttcataattgtatgctatgaaatatcagcagcgtaagaataatttttttgatatgttttccataaattttccataacagaacttatttctatttcatcaaatatttctcttctatccccagagtttatctgctccaatgttccacgttttcttgcagttgccacaagtgcattccataaaacttgctttttgagttgttttccatgcaacttttgtaaaatataaatatcataaaaatctctcattcgtgtatttgtaacgtttcgactaataacagtttccagtttttcagccaataccgtttccagattatatgcccatacctcgattgtgcgattttcaagcataagattaaagttgtacttgatttctcttggtgtaatgatatctcctgtagaaatatcaatctttaatggtgtgattactccatcaaattttgtttccatgcttacacgaacacccggataatctgcttcttccatgatttctgatatccgtttgatccgaaacaagacaccatcgttcagagggattgatataattttggatataatcatctctacatcctccacactgacattagtgccttttatggtagcatccagatccatagtagctctggcatccagaccgaccattgccgccaccagcatcccaccttttaatataaactgatttttatactctgataaagaaattcgttctaaaaaacgttccatcatataattccgcatcaaaatctgtgcatctgcggattttttctttgacagattacgaaccaaatcctttaattgtcttgccgttgttatcatctaaagtaacacctccaaatatggtcttagtatcttttcaacatggaacatagctgcgtatttcataagcattcgtaagtttttatccttacgtttcgcatattgctttaatgcatcttggaatacctgcatttcaatatttttcctgctgcgaagcagatcgcaaatcgttctctccatatcataaaccggaactgaatgtccaaatgatgtcagcatagttgtgatccctatttcatgtaaatccttttttactgtatacacttgaaaaccgtcttcctgcaaacggcttggattatatccatttcttactgttatggtgtatttcaaaggctctctgtccgttaaatcatgaaaaaacaatgcagtttcgtgagaaaatacagcttgaccacaacgcaaatgcaaaaggaacatcgcatctgtccacgtatcaggtgatacatacacaccatgagaagcttgctctaatcctcgttccttcacataggcataaaacacagacttactaattccattatttaggacttgaaatgtctgaattgtccctccacattcacgcaataacaaatctaatttttcaaattgagtcatatagattctcctttcatgctaatatgataatatatattagtatgaaagtaaatataaataatgccaatgaacaaattagattttaaaaatatccccgttctatcatccagcctttcacataacatcgaattccaatataaataacatgtgatagtaataggaataccatgagatttatcggaatagcatttttaatccattctccaaagtaaattacaatagctgcactcgttatcgccactatgatactgaggatatcccagcaatatttccggtagatttttccaacctgatagccaatcccaactatcagtaatccggttattataaataaaattcccataacaatagctacgatcagccagtacataagcccggaaaggatacggttaggtattccgctgcttaactgtccgaaagaatctgcacctatgacaaactcccgaaacaagcttcccattccttttcctaacacaccgaaaaaggtgatacagtcgttaaggaaaactggcgaaagaataaccgtaaacagggttattgttatactgtaccatgccagtaggaacaggatactttcataaccagttgtcatatttttaaatttcttttccagctgacttttgcggttatcgcatttttcttttgctttctggtaagcagtgcggtcacatttttcacatttctcataaggcacttttttctcaacagctatcattaattcttttatcatggtagaaaaaatcggaaacgaaaaaatatatgacacccgtttatcaaatggtcccattgaatcattaaacagaaaaatcaaagatttaaaacgcttagggcgtggtttccgcaattttgagcactttaggaacagatttctttatgcaacaagggctctgcctgtcttaaacggtgtttctgattataaccctgtatcttatcttgaaaacgacgaattttaggaggaaaatttcatggaaaactattgcgcattcagtaaaaatcataaatgcctcaactggactgattatgaactcacaagatatgaactagaagaagccggctctttatgccaggcaaactggattgaaattgaacgaaaaaatgaatacattcaattactacaggcattacttaacgatcacggtatcccatatcccgtcgaataataacgttcttacattaaaggggtctggcttccgccagaccctcattttcgcccctcaagtttgcccctcataaaagaccctcacaaagaaccctcaacaactatgcttgtttttatagtgaaatcctcacgaaagcccctcaacaagtttggcaaaccctcaagaactttgattatcctctattaaccgctaaagcgacagatttcttctcagccgtatatttattttgaatttttctttccttttctgactttgatcctgcggatcatccttcggatcagaaataccacaagcacaaggatcactataaagatcagacaaatacctgtgatcattgccgaaaacttattcggctgcttcaccagatcaatgatatttctgctgtcctccacaaccttacgtccatgtgtcgtctcataatattccggcacattggcaattccgtcgccatctgtatcctcaaaggactgcatatatcttgcgatcgcatcccaggcctttaattccctgtcaccctccatgatcgcctgatcttccagattttcaatgggattcccatccctgtccttcggttcaagagacagcagtccataggacatttacgtcacagaaccaagcatctggccggtatacaggtctgtcacaacatgatacagtttgtcattctggatctcgatccactctccgtctgccctggtgagataacaatctgtcaccttattcagaatcatccgatgtggattatatgcaaaattcaatccactgcaatataaccttgccgttgtcataaaatccgatacagaagcgtccacctccgctgccagcttcagctcctttccggtcaggtatgcactgatcagcggatatccggcaacaccgtcctttccgatccccagtgaaaaggaattaaaaacatcctctactgtgatatcgccctttgtgtatgtatcccgcacggttccgcttggaacaacggctacatcaaccggatcaccatcataatactcggaattctccactgcatatatgtatgcatcggatatgatatcaccaagattcaactcttcgtgcatcgtacccatttcttccagactgttgaattcaacatcattttcagcaagaacctcttctcttgtatagccaaaatcagcaagataattcttatccaccgtatccatcagggcatcgatctgttttgtctcggctgcttccaccggaacattccatgtaaagggaagcagtaatgtggcaacaagcatgattaccagaagccttgctgaaattttctttcgtgttttcatagccctctccttttgtgtatagttttcttatgcctttttacaaaaccatcaataatgttcccataccaatcaaaatacatccgatcagcgattttgctgtaaatttctcgtgtaaaaaaataaatgccagtaccagcgtgatcacaacgctcagcttgtctatcggcacaaccctagatgcatctcctatctgcagagcacgataataacataaccatgaggcacctgttgccaaacctgaaagtatcagaaacagccagctttttttactgatcgcagtgattccaccttgtgtatttgtgaggaaaaccattccccatgccatgacaagcaccaccatcgttcgaatcgctgttgcaagattcgaattaacaccggtaatacctaccttggccagtatggaggtcagcgccgcaaatacagcagacagcaaggcaaacacaaaccacatagtaactccccccttaaatataagttttttcttaactatcccaatacaagtccatcatatcattacccttctggtatgtcactatttacaatttcctccaccgtatattcctctatttctgtctttgtcacctgtttaatatgcttttttttcaggcgcagatatacgaattcccgaaaaatagtatagaacacggaaagcagcggaataaaaacaagcatacccacaattcccataaggtttccaccgatcgtaactgctgcaagaacccagattgacgggagccctacagattcacccacaacatgaggataaatcagatttccctcgatctgctgcagcaccagaaatactataataaataaaattgcctgtttcggatttaccataaagatcaaaaaacttcccactgcacatccgataaaggccccgaaaatcggaatcaatgcagtaaacgcaatcaaaactccgatcaaaagtgcatatggcatccccaaaatactcagtatcaccacaaacatgcatccgaggatcacagcttccagacactgacctgcaagaaaattcgcaaatgtccgataagtcagagaacaaattttaagaaaagcatctgcctttttctttggaagaaaggcaaaaactacttttcggatctgcacatgcagtttttctttctgaaaaagaacatagcaggcaaacgaaaaagcaataaaaaaggtcgctaatccactgactatggaaccaactgccgacattgtggtattcatcatatttcctgcaccatttccaagaagacttatcccccacttgatcgcctggtccggattaaactgtacctgatctaccagcttcatgatttcctggttattatgagagaattcccggatccagctttgcatctgcggaataaaatctacaatgctcatcatcagggttcccattgtccgcgtaagctgcggaatcaccccgaacatcaccagtacgattacaccaaccgccaatatgattgtaaggagcagacttatcggtcttgccagttttacgactatcttattttctttttttactcttccgaaaattttcttttccaaaaagctcattggcacgttggtcacaaatgcgattgctccgccaagtacaaagggaaacaggatcccccatattgctttcagcacatcgagcaccacatcaaatttccacaggacaaccacaagaaatgctgtaaacacaataagctccctgattttttttatagcaattttgcttaaatccactatctttctcctctttttcttaatttcatacgtatccatttaagcagctgaatgattggaagacttgcaaaagcatataaatatacacatccaagctgcatcagattcaaagtttccactttaaataagttatggaaaccaggaaccgtcagtactgttgtaatgagtactgtacctaacacaaatgctccctgaagccacttgttatgaaagagaccttttgtaaaaatgaccggatgatctgatttgcaattatatccatgaaacaaacgtgccagacaaagagttccaaaagcatacgtgcttccaagcaatgtaccattctggttgtatcctgtcaaaaaactgatcattgtcattgctccaattaccaaaccttccagaccgattttgctaagaaaatcttttgtcaatatcgactcatctgctaatctcggtttttcactcatcacttcacttctgtccggctctaagcctaacgcaattgccggtaagctatccgtcaaaagattaatgaagagtaaatgtactggtgcaaatggcaccggaagtcctgcaaccgatgaacaaagaacggttaaaattgctccaaaatttcctgacaaaagaaactgtatcgcatacttgatattctgatataagtttcgcccattttccactgcttttacgattgttgcaaagttatcatctgtaagtaccatcgctgctgcatctttcgcaacttccgttccggtcattcccatcgcaacgccaatatctgcctgctttaatgctggtgcatcattgacaccgtctcctgtcattgccacaatcattcctctttcctgccaggcccgaacaatgcggattttatgttccggtgacactcttgcatacacagaaatatttgggacaaattctttgagttcctcgtcactcatattttctatatccgcaccttcacaggcttccgacaaatcatgtaatataccaactctctttgcgattgctgctgctgtgattttatgatctcctgtgatcataaccggtcgaattcccgcttttatacattccgcaaccgcagcttttgattcttctctcggaggatccatcatcgcaatcagaccaagaaatactaagtgatcctcatcttgtgacgttaatgtgtgattcttaggaatttcacgataggtaaaagccagtactcttaaaccttccatcgagaatttctgattttgacgttgtattttttctttatcttcctcagtaatttttcgaattccctctttcgtccagatttgctctgtacgttccaggagcttgtcgactgcaccttttacaatcatttgatttttaccatctatcaggtgaagtgttgacatcatctttcgatcactgtcaaatggcagttctccatttcttggataaagctttcttatgcttgctgcctctactccatatcgacttccaagattaatcaatgctgtttctgttgggtctccaatttctactccattttcatttgtcgaatcattacatagaatactataatttaaaagacatttttgtgcctgatctgatatatcaattgcctctgctgaaattctttttccatctatataataatcttcaactgtcattttattctgtgtgagcgttcctgtcttatcagaacaaataatagaaacacttccaagcccttctaccgcctgtagtttacgaatgattgcatgctcttttgccatcttctgtgttccgaaagaaagtacaattgtcacgatagaacttaacgcttcaggaattgctgccactgcaagtgctactgcaaacataaatgcactgctgatcttttcaccgcggaacacatttattgcaaataagagtccgcaaaatatcagaatcataatggaaagcttctttccaaagacttccaaactcacctggagtggtgtctgtttttccgaagttgacttcaaaagtcctgcaatctttccaacttctgtctgcattcctatatccgttacaatagctttcccacgcccatacgttacaaaactactggaaaacagcatatttgcccgatcaccaagtggcgcttccgtcaatattgtatccatgtttttctcaactgcaagactctctcctgtaagagcactctcatcaatcttaagacttgcattttcaatcagtcttccatcagccggaatcatatctcctgcttcaagcagtatcacatctccaacaaccagttctcttgccggaatctggacgattgtaccatcacgcaatacctttgcctccgggccagaaagattctttaaactctgcagagattgttctgcttttaccgtctgtattgttcccaagattgcattgatcgtaataaccgtcacgataactgccgcactttccacatctccaagcataccagatatgattgctgatgcaattagaatcaatacaagaaaatccttatactgttcaaagaaaatctgcaggatgcctttcttctttccttctgtaagttcattccacccacatttttctctggatcttttcacctgttcactcgtaagcccagatttcttcccattcaccctttcaagaacctcttctaccgtctgctgataaatttccttcatcactttcgcctccttgtttctaagtatttactacctggatttctcattcaatgaaagacctctttgataaaaaaacataaaaaaaggagaccttcattgcataataaaaatgcaataaaagtctcaccatttccttatgataccggatgcttccaccgtactgacgacatcacaaacgcaaattgttaagcgcaggttactcccctttattggatcaaatcatatacccaaagtaacatgattgtcaagatgctatatcattactttttcattctatgttatacttattacatcgttaacactattaaaataaattcttcggaggtgaatcaaatggatcatacgaataattcctgttgttgtggtgaagcagaatatttttccggatgtctgatttgtggtgctcctattacgtatcgtgctgaaagctctattcagacgtgcagcatctgccataaagaacaattaaccaatgcggtctgtgaaaatggtcactttatctgtgatgcctgtcatagctatggcacatatgctccggtaatcacgacactcagggacagtacagaaaaagatgctttgcttcttctggaaaaaattatggatcttccatctgtacatatgcatggaccggagcatcatgcaattgtcccatgcgttcttctgacagcgtttcgcaataatggagaacatatggattacgatgctgcattatctgagatctgtaaaagagcaaagcaggttccaggcggtacctgtggttactggggtgtctgcggagctgctgccggagccggtattttcatgtccgttatgactggatccagtccactttacaaagatgcatggccgtttcctcaaaaacttgtttccattattttatctagactggcagatgttggtggacctcgctgctgcaaacgaaccagcagaattgccattgaagaagctgttcatttttacagtcagttttgttctgtaaacattccgttgtcttctataacgtgtaaatactgcaaagataatcgcgaatgcatccaggaagattgtccatactattctgaataacagacaaggcagtgattccatgataccacgaaatcactgccttgtaactcgtttgccaggatacagtgccagatcttcccactttacttttctgcagttccatgaacgaatatccttctcttccaaaacactcctgattcgttcttctccattgtccgatgtaaaaagcgctgtaatttcctttttcccatctacaattttcacacaataatctaccagttccggaatctcaaacagcaattcatccatctctctgatacttcccaatggatccatccgctttacaaagtccaggcgttttatttcacttccacagaggcatcttcccggaatgatccttgtccagtcaccggttcgatatcgaatcaacggctgtgcttccattccaatggttgtgattaccagttctccccactcaccgtccggcagcacatttccgttctcatctataatctctgtaatacaatggttttcccgcatatgcatgccatcatgcgccgtgcagcaaatggcacctccaagccccatctctctggaaccatagtgtggccaaagtcgtgtttgcagaatttcttcgattgctttcatgacagtttgcggacaggcatctccggataccagtgctctttttatactgccttttccgcacattctaagcatggaaagcaatgcagtcggcattcccacatacgtatccggctgctcctcttccagaatcctgtttagttcgccataagttcttcctgttccggttgaaagaggttttgctcccagacgtctgattgcctccgcgatcagttctcccaatccaaaaggacctgaaaatggcatagccaccatcgttatactaccaggataaataaattcacccagacctgccataaaaagttctatggtgtgttcacagtctccctctgtatagaatacacgtttaccggcaccggtagttccgcttgtctgttctgatatcactttctgtacttccccctgggagcaaagcagcatcctgcctccatctcgtgccagatctgtttctgttgtaaaaggaaggcttctcagatctgtcaggctctccagtctttccggcaaatctcgataaaaaccctctcgttctttttctttcttcagtacaatatttaatttctccagctgcattctgtgtatttcatctcttgtaatctctgtaatgccttcctgcttacagatcattgcatctatatttgatcgtttcactttctgtataaatatattcctttcgaattcgtcagattatatgcacaaaacggcaccattccataatcagaatccacctcgcagatataacatcttttcagacgttcaagatccagattccatgcatcctgaaaaatcatccctgataccgcaaaggtttcattatgaacccggattaggaattcatccagcgcatctgtctgtgtcatttctccatcatcaaatttttttgtgctatagctccactgattttccacatactgcctggaatcatcgctggtagtacaacaacatcctctgcctgatttcttttccagaagtttcagttccctctcaccttttttcagataacttgcatgaaaagaacagtatggattctctactccaccaccagcgaaatcctcgcttttcataaacccgtcagtctgttcctcgatcagcttcaacatctttggtatggtaatcggagcttgtggacgctgctgagaacatctgccaaaatagctgatcggctggaaatgtactcctcttacaaatggcatatgatccatcgcaaacttcaggatatctccaacctgcatatcatttactcctggagcaatgacaggtaccagggcaattcccagttccgcttccgaacagtttaacacagccttttctttcagttccatcatagagcgtccgcgcaatgtctgatacacgtcatctgtgacaccgtcaaattgaagaaataccgtattcagtcctgctttttttagttttctggcatatcctgcttcctgcgcaagacggattccattggtattcaattgaaaaaatgtgaatcctttttctcttcccatatgtatgatctccggaagatcctcccgcatggttggttctcctcctgagagctgtatattgaatggtcccccatgatccatcagaaaatcatattgcttttctatttcatcaattgaaagatcaccgttttccagacattctcctgccgaagcaaagcataccgggcagtgcatattgcagcgctttgtcacttccagtatcatacaacatccttttcgttcgtgctcctcacaaagtccacaattatccgggcaagatttctctttgatttttggatttacaggagtctccgcagacaggttttctctcccccaggaaagatactctgctgccgttccttcccagatcagtgtctgaaactttccgtggatatcacattctttcaccagataaatgccatcttcaccaatacattttttagccgtaagtactttcatacatatcggacatacactttttgttttacccagcgtaatcatagttccaatattccccgttctgtcagtatttctatcacttttgtataagtatctgcaatcaacgcaggacattgctccatgacaattccccaatccagattggaagtgatgtccttacaataaaaagcaccaaactcttcttcggtcttcttatggaaccactgatataattcctgcacagccggtttcatctgtatatcttctttctcctgcggagccagattgccaaggaacaaacctatcgcacaggctcctcctgtcagacagccacatgtatctccacagtaaccgatgccgccgccaagaccgcccaaagcctttacaagctgtggattctcttcccctatcgtttccagtgtcaaaatcataatcatctgagaacaatgataacccatactgctaagttctatgattctttcataaagatccatatgttactcctttctgccaaccaccatggtatagcgcagcttctttcctttatattctttctgcagaatcttatactcttcgcaacagaacgaatcattccagattgcttccagataatattcacgccaaagtaacgtctgatcctcctgccggagaatggtaaatcctgtctgttctgccatttctgaaagatttccagtatccagatctgacaataatagaaaacctccctttttcagaacacgccaacattcagatagtgcatttttctgatctctgctgacaaaaaatgcacactggctgatgcaaagatctatactgtctgatggatactgcaaatgcagaaaatctcctgtttccacatcactgccccgtgggaaaagatccacaccatgtgcatccatcccaagtgatttcaggattcgtatcgtgtctccttctccagctccaagatccagtgctttcatttcttttttccattctatgttctccagaagataaagcgtctgcgcttcccctcccggatgcctgttcatctatttatcctccagtgcacgctccaccgcaagaacttttccaagtgcgagttcttccggaacatacacaaatccacactttggacagacaggcatttccacaggaaacccattttccagatacataaattttgcttttccttttacaagaggaaccttacatttcatgcaggtcagctttccttccggatcaatcgtataatatgttctttctaccgccattactgtcccacccttttcataatattcattctgtgactgtatgctctgcgtaccagatacccttcttcagtttccacaaatcgcacccagaatgtcacatttccaagtctgctccttgtcaccagttcttttgtctcttcatcaaaaatcgcttcctggttttctctgtaatctgataatacacgctccacatcacttttcagtatcatacgttcatccatcatactgatagcatcttctgtatatgcaacggtataatcttttttctccatcatcagttcctcattccatatattttttaaaagcttctcttttagcacaagccggttgtagcgtttttcactgatatccggcatattgacggcatttgtgccatacagaagttcaaggatatgtctggattccctgccttccctgacaaatcggtccctgcatgccatgcagtacgttatatatggggcatcggatcgttccagacacttttctgtcattttatctgccatctctttattagcgcaggaagtcagtccgccgtatccgcaacagggagacagatctctggaatattctgtgtttacaacagtgcaccccatatctgcaagaagctctcttattatgtcctgtgtctgcgcatcacccctggctccgcaggcatcatgtattgcaacaggtatctccagcccttttgcctgtgcgggaagtccgatttcctttaagatctcccagattcctgtgactctgacaccaagactctcttttaactgtttcatacagcttggacagcctgctatgatcatgggatctcccagctttgcaagctcctgcttcagctgttcatttaccttttctgtcatttcatagcgtcctgcccattcactgatagcaccacagcatcccagcatcagagcaacaccgccctctgtcctcctgcaaagatcctcatatgcatctgtgacaacatccggcgctatggctcctgcctgacatcccggaaaaaatacatatctgcaagtttcatatcccggctgaggtctgcataagaaagcctccgaattggagaacagcatatccatcagtgcaaattcatgaggtgccagaggcatcttgtctgtagataccatattttctcttgcagatttgcagacctggctcatatcaaacccatttggacaggttacagtgcactgtccgcagagcgaacaggaattcatcggtttattcatctggtgatctcccataatgatctgggtattattataaatctcacgtgcaagaagacccggatgctttttgtattcacttaaataaacacagcttttcatgcactcatcacaatggcactgaatacatctctctgcttcttcaacagcttcttcttttgagtatccatctgcaccacaaggaatcctttctgatcctttgataccttctgtatttgtatagagcttcgtggtaactgctccttcactgcctctgttgccgtgtggtgaaagattctgtgcaagaagatccactgtcagggcagctctctttgcggcaaaagcagcatccataacagattgtgtcactccactgacgatccctgcctgctctctcagcatgatctctgtatctgctgcttcttccggggcaagcttttgtgcgatctcttctgaagcacagaccacatctgccagtttcattttttctctgataaatacaggatcaagactgcagccgaattcaaacgtaaggtccatggctttcaggcgttttgcctcatttttgcagtctgcctcagaaagatgtgcggctgcggctgcaatatactccgcataatcttcttcctgacagtaaacagttgcaggatacatttttctttccagttccccggcaagaaacagcacaaataatcctgaaccgaagatcgctgcttttttcttcttgcgcatgcggaacacgctgcttcgttttgaagattccccataacgtacaatcgcacgctctacttcacgtatggagataccatcacccagttcgcagagcttgcatttatcttcgcagggtgctgtacatccatcgcaaagaatcataggaaatggagtgatcttctcataaattgccagtgctttcttaaagtttccttttgaagcataaaacagcatttcttttgtatctaccttaaaaggacaggctgcaacacaatacgccggctgatcatgaacgcagagactgatcatatgatccatttcttcttttgacattcgatttacgtgataaacatgagtggaacctctctcctgtatgtatgtcataacctgcactcctttcactgctgcttactataaactttattcatctcaaaaggggagacagtataccgtctcccctcattatatcacaagataaatttagatttatgatttaattctcaagttccttcaatgctgcaagaactctttcaggacgagccggaacgcgggtaatacgtgcacctgttgcgttgtagattgcattcaggattgccggatgaggagcatccagtggagcctcaccacagccggcagctccataagggccgcttggacgataggtttcattgaaatgaagttcaatatcatccggagcatccttaggatacgggataccacagttcttcagagtagtatcatggttcagatcctcaaagtcttctgttagagcaaggccgacaccctgtacaagaccaccgtagaagttaccctctacaagaagtctgttcatgatcgttcctacatccgctacacaggtgaacttctcaactgtaaccttacctgtttctgtattgacagcaacttccggaaggaagattgtatacatataagttgcaaatggatctccctgtgctgtatcctgatcgatcggatgatctgcacagaatgttgttacccagttaccttcgtattttgtttcaagaccttcagctaccatctcatcatatgtacggaaggttccgtcttctttcttcattgctgcaacaagattctctgctgccagacgacatgcattgcctgacataacctgtgaacgtgatccgcctgcgggacctgcattcggacaggtcttggtatcattcataacaagtttgatctgttccggtctgattccggcctgacgaagtgtttcatgagatgatacaagaacacccatgtcggcaccctgtccatgatcttcccatgcagcatacattgtaactgttccatccggattcagttctgcaaatgcatttgatgtatcaacaccatcaagaccgcagccgtatacaccaagagatacaccgataccatatttgatcttgccatcagaaactgcattcttctcagcgacacgtttcttggctgcttcatacagcggacgagctgtcttgaacagatcttcctcacagtatacttccggcggataacctgtcgggatcgtagttccttctgattctttgtagcagttcatctcacgcatatcgaaaggatcgattcccattttggctgccagaacgtcgattgcaatctcagatcccatgtaagactgaggagaaccgtatgcacggaaagctgaaccccatgcatggttggtaaatactgttgttgatttattgcggatggaattgattccgtaaccagcgcctgtgaactgagaaagtctcattgtaagcaggtcaccaaattctgagtatggaccatgatccacatagttgttaccccagagtgcgaggagtttgccgttttcgtctgctgcaagtttgatattcataaatgcaggagatctctttcctgtataagtaatgttctggaactgattgaataccagcgatacaggacgttcaaggatcttgacagctgcaccgatcaaggcttcatttgtaggagagaacttgtaaccaaaggttcctccggcatggttctgaacaagtctcaggttctccagcggaacaccgataccatcagcgatcatcggcatatggagatggataccgatggatttggaatgaacagttatcatgccgtcttcatcaatgtagccataaccacagtccggttcaagatggagatgtggctgacgtgaacagtaggattcgatctcaacctgctgtgaatccggaatgctgtcccagtcaaaatcaggacccttgatacagtttgtctcaaagaatgcatttggagtacccggatggatctcagctgcatccggtgcgatcgcatccattgcgttcatatatgccggaagttcttcgatctccaccttaactgcatctgctgctgcccgcgcatgctcttctgtatcagcagctacgatcgcgatcgcatcaccaaactggaatatcttttcgtcacagagtacaggacgctcaaagccgtctgtcttattgtgtttcggaagcattacaagaccattgatcttgttggttcctcctgctgccttaatgtctttggctgtgataacacgaacaacacccggcatgctctctgcttctgttgtgtcaatactgaggatatttgcgtgagaaaccctggcctgtgtaagtgcaaggcgaagtgttccctccggcatctttaatgcgtcatctgcaccgaaatcccaggtacctgttaccttctgtgctgctgatggacggatatagtttgtaccaacaatagaatcacctgtctgtttgaatacgagatcttcttttgtcatttcgccgcgcataactgctgctgccgccatagttgcatcaatgagcggcttgtaacctgtacaacggcagagattacgctgcttgttaaaccagtccctcacttcttcacgggtagggctcggattattatcgagaagaacttttgctgaaataatgaaacctggtgaacagaaaccacactgtgcacatccatatgccatccatgcaacctggatcggatgcatgtcagaaattgttcccacaccctcgatagttgtgatctctgcattgtccggaacacggctcatcttgtagatacaggatcttgtaacttttccgttcataataacattacaggctccgcaatggccttcaccacagccgatcttacatcctgtaagaagaagatgattacggagaacctgtgccagtgtctcgtccttatcaagaataaggatcctctcaacaccattgatcttcaatgtctttttaatcatgctgcatccctcctatagaaaatataagcttcaatgttattgatctttaggcttatgtgttccgcatggatcatgatccgcacctttgcctgtcagatctttgagtcgttccattcctctggcggaatagaaaacaatagaagaactgctcccgtccagattctcaccgctgagtcttaagacatttgcattttcataataatcaattggaagcgtccggctgtattccactcccgtgcgctcatcttttacctgtatggtaactgcttttgcggtaatctcaaaaatcttatccatagaaaagttctcctgtttacgtcattatgtatatattcatactatcataattttgcacaattatgcaaattacaaataattaaaagttggacattttcacacttttttctttattttatgatataataatatcaattttacacaatattctttaaggaggtggcagtcatgcagacaggtgctctcatcgttgctgcgggaaaatcctcacgaatgggagactttaaacccatgcttcaacttggatctatttccattgcgcagcgcgtgatcaacaattttcgacaggccgggatctccaaagtagttgtagtgacaggatataaggcagacgttctggagcgccaccttgcttccaacaatgtgatctttctccgaaacgagaactatgcaacaactcacatgtttgattctgtccggatcggactggaatatctgaaagacaaggttgatactgtactcttcacgcctgtagatgttccactgttcacagcccggacagtcacgcagatgctctcgctggaatatccccttataaccccggtctgtgacggcagtcccggccatccacttctgatccgttccacacttattgattccattttaagtgatgacggccgatcaggccttgaaggtgctgtagaaaactgtggcacacccatgtactttctgaatgtagatgatcctggaatcattcatgatgcagatacaccggaagattatgctgaacttcttcgtgcccacaacgagagtctgatccgttcagaaatccacattcaactggcacgggaaaaagtattctttgatgagcagctttattcgcttctcacactgatccgggaaacaggatctgtacgtgatgcctgtgaacacatgcatatttcctactccaccagctggaaccttatccgtacattggaatcacagcttcatgaaccgctgatcagcagaagtcagggtggtgtaaatggaagtcatagtgaactgactccatatggtgaagaatttctgaaacgatatgctcgtttttcagaaaaaacacgttcctgttcaaaaaaaatatttgaagaatgtttcggaggatttttaaatgcgtagcctttatctggtccggcatggaaaaccacagtatccggatgaacattcttactgtgtgggacagacagatttctctctatccatgcttggacacttgcaggcagtccttcttaatgaagaattgtccgataaaatatcaaggatatactgcagtcctttgttaagagctgttgagacagcaggccatatggcacctgagcttccacatataattgtttctgatctgtcagaacgaaatctgggagaatgggatggcctttcttttgataaaatacgccagagatggccggacatttataaagcccgtgaaaataaccctgatcatccgatcccgggagcagaaactcctgctgcatctggttttcgcttttcgcaggcagttcataagattctttgcgcttctgaaggtgatattgcagtggtagctcatacagatgtaatctcttcttatatatatgcattacattccggtatgtacagcaggcagcggtttcgtcttccctgtggctcttactatcatctggaagtgaatgaaagaaataatatttctttctctgatcccaattatatactgcctcatcctgaattaaatgacgggctatgcttcaggcttcgcaatgcggtttctctgccccgtcatgtacaggctcacagtgatgctgttactgaacttgcctgttgtttatgcaatatgttggaatccaatggttatatctttgatcagaagcttgttcgctccggtgctcttctgcatgatatcgcccggcttcagaaaaatcacaccaagacaggcggtgaactttttttacaactgggttatcccgagatctgtcagatcatctcacaacatcatggtttaaaggaaacaaagctggatgaagcagctattgtatttcttgcagataagctgatcgaggaaacgcagcgtgtatcaatagaaaaaagatttgctgacaatctgtataaatgcaaaagtccggaagctctgcaatcgcataagcttcaattaaagcaggctctcacactgcaggatatgatacaatcgatctgtcatacgacactttaacatacaaaatcacaggaggatttttatatgagaacattatttcagacaataaaacagcagtttctggaggaaaatgacctcgtacttgcttccataacagcttcatcagggtcgactccacgaggtgccggctcccgcatgctggtcggaaaacacggcagaattaccggaactatcggcggtggtgccgtggaataccgtgctgaacttatggcactggatattcttgaaaaaaaggaatccgatgaacacgaattccggctgaaccgtaaggatgtcgaaaatatcggtatgatctgtggtggtgatgttaccgtctttttccagtatcttgatcataatgatccgattgttatggaaattgcggaaactgctgaaaaatcatatgaggaacgaaaggatttctggctgatctgcgatcttcatgcaacatccggcatgagtctttacagcccttgttatggtctgatcggaaatgctgatgttccttcttccatattatcatccttatctgcacagccattccgctatcgcagtgaagattatgatctgttttctgagcagatcggaacttccggaactgtctatgtatttggcggtggccatgtttcacagaaacttgtaccgatacttgcaagcgttgattttcgctgtgttgtcctggatgaccggccggaatttacagatcctgctcttttcccgggagcagttgaaacaatactttgtgatttcaaccatctggaacagtatgtttctatcacagctgctgattattgctgcgtcatgacacgcggacattcctatgataccattgtacaggcacagcttctcgctacacctgcatgctatataggcgtcattggaagccgcgcaaaaaaagctgctgtatttcgccgtctgattgaagaatacaacattaatgaacaagatttaaaccgtatcatctcacctataggactggagatcaaagcagaaacaccggctgaaattgccatctccattacaggacagatgatccaggttcgtgctgacagaaaggctacatcaaaatgatggcaaaatcagtatataaaactgtaatatttggtgccgggcaaattggacaaatgacagcaagacttctcaacagtccctgccagctcctgtgctttgctgataatgacccccataaacacggatcatatattgggaatattccagtctgttctccggatgctgcagcagcacttctcccggatctggtcatcctgggagttctggatgaagaacggcgtaattctatgataaaacagatggaaaacctgggttatcacgggccttttcgtgatccctccgtccttcgcatgtttgacgcacgggttgctgttatgcgtcttttatctgagcagatctatcaattggatattccgggaaatgttgcagaactgggtgttttccgaggtgaattttcttccctgatcagtgcagcctttccagaccgaaaaatccatctttttgatacttttgagggcttttcagaaaaggatatcacaatagaagcctccggtaatctgtcccgcgccaaaacaggtgatttttcttctactgatattgactctgttcttcatgttatgccagatcctacacgtactgtgatccacaaaggatggtttccagataccttttccgatgttagagatgaaactttttgttttgtatctctggacgcggatctctatgctccaactgctgctgcacttcctctgttctatgaacgcctggccatcggaggagttctcttggttcacgatgtgtacagtacacagttttccggatgccgaaaagcggttggggaattctgtctgaaaaaccatctgtttgcagatcctgtatgcgatctgcatggaagcgcaataatccgaaaattataaaaagaaacgccggaaccggtatttaccggaaccagcgtttctttttcgtttatttattgtatagccctttttcacgtccatgcctaacctttataaagttcctttcagaacattttccaactgttcatcggacagatcaacatgataaaaaagatcgaaaaatttatgtatttcttcattgatatcacatttaatatattccggataaatcaatgctgagaaccatcgcataccgatcagacgatttggtcctgccggacgatccacccagctaaacggtgcattcggagttccataaaccttttggtcctgtactgcttttaatgaagcataatcaggattgctcaggatatcttctgctgcagaacttccgcttttatctgcctttggttcaccatttacaacaatcacatccggatcccatgcaagaagctgttctgctgaaatctgaacacgagatccatctcccaattccagatctgcaacattgactgcattgatggcatcaagaatctgtgcatgctgggatcccctgggtgcagtttccagtgaatcctctccattaccgaagtatacactgactttcttttcttctggaatatctgaaagtacattaatatcagtaaatacctgctccgcatactgggcaagctcttctgcatgatcttctacaccaagaagttcgcccataaaacgaaaagcttccgcagaattattaagctcgttgtctactgcaacaaccggaattccaaggctttctgataacgcatcgcaatcagaaaccattgcatcattaatctttccactattaatagcaattgtaggattggcagcaattactgcttcataattgacagcatcacccattccaaaattaggaagatcctgatatttgtccagaataatagatttctcaacatcattcagttcataattccacccaagaagcttatccggtacaaccatatacagaaaaattgcagctaccggacccgctgaaaaaacagattcaatattttctgctgttgggacagttacttttcttcctgccatgtctgtgatctcacgggtttcagcagtttcctgcgtggcatcctgctccgcactctgcgtcggctcttcagtagcagctttcgtctcagaatatcctgttaaaagactgactgacatcaccagacatataaacagagccaaaagttgtctgtgctttttcatagactctctcctttcttttctccgcattactcataattgacgcttattgaaattgactatacaatttttaagtattataatgtatatgcgaatagtttttgaaaacaattcgttttttttgagtataacaccgtaaatttgattagtcaagttacaaggatgaaggattatgaatctgacagctaatgaaaaaaatgccgccgctacccgacaaagacgatatgttctgctgttggcggttatgctggtacttttgtttatcattatagtactctcattctgggtgggatattatccgcttacaccagtgcaggtactaaatgcatttttatcaaaatttggttttaaaggagatattttaccccaggcagttactatattctggaatatccgtctgccccgtattctgtctgctttatttattggtgcttccctctcggtagcaggtgcaacctatcagggaatgtttcgcaatccactggtatctccggatatccttggagtttcttccggtgcaagtctcggagctgcttttgcaattttaaacggagcttccaactggatgattcagctttctgcttttgcaggtggtgtggccgcagtagccgcatcctatcttatcagccgaaaatccgcacattcccagaccctcagtcttgttctgaccggaactatgatcatgtcactctgcaatgccggtgtcacaatgatcaaatatgtggcagaccccaatgatgttctccagcaaattactttctggcttatgggcagcttaaccaaaaccacaaccaaatccttttgctggagtgttcttccaatgatcattggattaagtctgatttttatttttcgatggcagatcaatctgctgactttggatgaagaagaagccaaaagtttaggaatcaatgtgcgtaaatatcgtctgatttttatagtcgcttccacattactcagcgccgctgcagtctgtcttggaggattgatcggatgggtcgggctgatgatcccccatctggcacgtgcactggttggtgttgattacagaaggctgatacctgcaagtacgatccttggcggcggatacctgatacttgttgatgatatttcccgttcccttttgtccatggaacttccacttggcgttgtcacaagtatcatgggcgcccccttctttatctatcttatcatcaaacgaaaggagcgcgcgtaattatatgcttctggaaattgaaaatgtttttggcggttacggcaatggtgatattttaaagggtatcagctgcagcgcagactatggtgatgtgctttgtctgcttggccctaatggttgcggaaagaccactctgttccgcataatattaggttcccttcctgtttctaatggaaaaataaagatagccggaaaaaatattagtgactttacaaccaaaacactggcaaatatgattgcatatattccccaatatcattcccctgtatttgcctatacagttcttgatatggtaattatggggcgtgcttctcatttctccgcatttgaaaccccaaaagagcctgatcaggaagcagcttttgctgccttggagaaagtaaatgccctgcctcttgccaacaggaaatatacttccttaagcggaggacaaaggcaattggttttaattgcccgtgcaatctgtcagtctgcaaaaatcttcatcatggacgagccagccgccaatctggattatgccaatcatcagcttctcatggaagtaatttcagggctggccaatcagggctattgcattattatgtcaacacatagtcctgagcatcccttttccgtgggaaacaaagttcttctcatgaaatccggaaaggttatgggattcggctctcccaaagaaatcattacatctgaaaccttacaatctgtttacgatattgaaatggatgtgataactacacacgaccgctatggccgtgaacgaactatctgtttaccggtaaatagctcaccaaaagcattttaggagaaatgatacatggactctatattggattattttatttctctgcaggaatctgagcctgcagaattacctgagcgggctatagaaagatggaataaacgtgcagacttttgggaagacgcacgcaaaaagaaagaaaaaggtgatgaacgtgtcatcagcgcaataaactacctggattccaaaggacttcttgaaaaaaattatgatgtcgcagatattggatgcggtcccggacggtttgctgctgcatttgccaaatatgtacacaaagtagtggggctggatatttctgataaaatggttaaacacggaatggaacatatccaaaatgaaggcttaaataacgctatactctatacatgtaattttcagacattagatattgataaatcggggtatacgcatgcatttgatttggtattcagttccatgacacctgcaatccacaatatggacggactgataaaatctatggaaatgagcagggcatggtgctgtaatatcacgcatcttgacagacgaaattcactcagggaacagatcttacaggaagtatttggcaaacaaacagcaccccaatggaatgggcgatggtttttctctcttttcaatatattatttctgcttggatataatcctgaaacaagctatgaaaaactccatcgtgaaacctgggtaactccggatgaacaatatattgattccctcatggagcacatgcttccttctgaagaatatacacaggaaaacgcaaataaaatcatgcaatggattcaatctcacttaaacaaagatgggcagatcaaggaaataactgattccacttatggaagaattctctgggatgttcgaaacaaaacaatacgccctgactatagaactattataaaatgaaatgggactttactatgactcaacatatatttttaactggtaaaaaacacattggaaaatctacattgatccaaaagatattagatgattataagaaaacctctgatggattcctgactgtccgcacaaaaaactatctgaaggatcagtattcagttcatatgtaccatctaaaagagaaggagctcccaaacaaatctaatcttttgtttttatgcggaaaaacagatgaacacactgccgatacctttgatcgccttggatgcaatattctttccatgtgttctgactgctctttaattgttatggatgagcttggtccacatgaagcagacgcagctttatttcggagaaaaatcctaaaccttttggatgggcagactcccattttaggggtattgcaagaacctgcagaatctttctggcctgaaatcgtaaatcacccaaaggtagaaatcattataatttctgaagacaatcgaaatgattgctctttacttaatcacattcaatataaaatctcatctccttaataattactcccggggctatgcgttcggaactaaccaaagggtcaagtagctttgtcaagtaaatcgagtaggagaaatatctcatcttgtgaatgagatatttcgacctctcacaccactgtgcgtaccgttcggtacacggcggttcaatcaacttagcaagtgacacacctttcggtgtagtaatctaacattgagactaatccaaatgaggctagtcttttgttggtaattacataattcaatgccccgctacatacatgggctatcctcgctcctgtgtacgctatcgagtatgcatcttctttattcattccaagttttatcagattctcagcacggttttgtggtgttttccaatgtttccaaatgcacatacgaagtctgtacctgatattactgtcaagttctttgcagagtgttttcatacttcctatcttgaagtagttaatccaccctctgataagctgattgagcttttccaccttgtagctgttgctaacgccccaactacggcaagtgagttttctcattctgttcttaaacttcgctactgattgctttaataaaggattccttgtcggcaacaatcatcttgttgctgtccgtcaatatgatgctgtactttccgtccttgtaggcaagctcctttgtgatgtcattcttaccgcccgacataaagctcggaatggtgttatgctcacgcagcattgcaacaatctggtcatacactgcccttgctccgctgttggcataatttgaaccgaagtgcaggctgtaaacggtggtgcttgtctggttatatgagcctgtggcttcacggcagcctgtgacaaactcccatacgagagtctgcgtggcaagccatttttcatcatcacttcccgacagattatttcggttgccctgatacccatagagcagggcaagcccaaccgcctttttctggttggctgaaagtgcgttccaagtatcagaggaagcctttttcaaggtgtttcctgttttcagcggtactcccggctgaatacaaaacgcattctcgccatccacaaacatacggtacttgtaatttcctgttccgcctgcggtataaccaccgatattcgcactggaattgtacctcatcgcattaccgttgctgtcataggtgtgggaaaaggaaatcgtcccgatgtcacccacagcaaacgccgtcgcaggcattatggataatgccgtgaccgcagccattacaaaagccgcagcctttttgaacaatttagggattttcatagttacctcctgtaatttggattgaatattttgccttactgaccgaaaaaagctgcccgttatggacagcttaaagtatttcttttctcggatagttactggcagtagttagggggtgaggtgtggagagggggaagccaaaataatggctatccactcaaaaaggcagacctcgccctcggtgtgtggctatctctcgtgagccttgttccgctgcaagtgtcggttataaaactccaacgccttgacaacaaaatccgtttcctgccctctgggaacagtcttgggaatgagcttggttatcctctcgtcacggaaagcaggtttttccttctggttgggcttttcttcctccataatggactggataacctcggaagtgagtttaccgtcttggttatacttcttcattttgatagcctgtgccaatgacggggtagcatcgttgtactccattgcttcaagcagggtgtattgctgttcctcggtcagataggaaatttcaaccgcaggacggaatgcaatctgcctttcatctaccatttgcaggatttcgggtacaagctccgttagacggatatagcggcggatttgctctcggctttctccaacctctttacccaatttctcatttgttcgagtagtatctaaatctgacaccattggtgtcaaattatctttgctcggtctgcctgcttgcctgttcattgcttccaaccgcattttatacgcaaaggctttctcactcggtaaaataacagacctctgcaaattgtaggctaagaccacagcgccttgccttgtctccaagacaggtttccatagcctcgccccgaaaccgtacgtacatctctcgatgtatacggcttcccatttaccatagtctttcagttatttcgtgattttggcatagcagttcggacaaactgcaagtgtcttgcgacgcttagccaacataatagtattccattcattgtctgcttggattgatttcaatgatcttacatggtgcatgcatatatcacctgtgttttcaccacaaagttcacatacacctagcttaatccttgtcctcagataattcggattatcatatttgacgtattgtggcaataagtcaggctcgaaaccgcatgcataacgtttctttttgaatccgtcatgataaaactcgcagtatctcaatcccttctttgtattgtatggaaccatgaatatcccgtttttgcggtactttctctgtatcttataaacactctttcgatatttcagtccgaaggttttgtacatgctatattccaagataaatgcaaagtttttgatgactgttgcattttcggcaatggaataataattgtacattcctctgatttccgcatttacttgcgacactatttccacgtctgtcatgtgaaccatatttcctctgtggtgtgaatcccatatttccttgccatttttgtcatacctaatccttagagcaccatactccgtcaatttaccttgccatttatctcttggggcgtacaatttaattctggcaggattcttaccgctttttagtcaggattgcgaacttgtttcgcaattacctagtagtatttccatatatctttattatatgcaaatgtccgcacaatagcaatactaattttatgctccaataatcttattgaataactgtggtgaaatgtagagctgaaagtacaagtgccactatatatccgattccacagaaaaattttatctcgtttattttctctgattgcaatcttatcctttttttcaatttttgcacttcctttcaggcaaagaaaaagacgcaagccatatttctataactcacgcctttctctgcacttatttactttacagttccaattcgctacgcactgcgtatccttttagaacttacttatttcgtcagaacccgataattttctttcttatcataatctttatggattccatcatcttcatacagagtatagctgctgccttcatatccgataagctgcatattttctgtatcaatatccttcacgcactctgctgcttctgcaaccgggatgcatttgccgctgcgaatgaaaagcggtacttcattgagtgcaacctctacataatgaactcccttttcgaggacttcttcagaaatgcttccatccggcataaacttaatgaatttcatttcttctggcaggtaaacgtaacggcctcttgcgttctgctcataaaccggtgcgatcatgatctcgttaccaagcatcagctggtcttcgacgcggattgccatcttatcatccggataaacgaagccaagcggtttaaagtacatatcgtcattcaacgcagctttcatgtattcactgtaaagatacggcacaagacgatatctggcgttaatgacactgcggaaatcttcgatattttcgaactgataacactcctgttctcttgttccttctgccgcatgatcacgcatcagaggtgtaaacacaccgagtgcaaggaaacgaagcagaagatctctggtcgtgtcgtcaccaaatccaccaaggtctgcgcctgtgtacataaatccacacatattcagagatggaagcatcttcagatttaaaagaatgtgtgaccaccaggatttattgtctcccatccagattcctccgtaacgatgcattccaatataagaagatctggaaaacatcaggaaacgtttttccggatcaatgcgttcgaatgcttctccggctgctcttgtcatgttataaccaaaaagattatgcactttgtcgtggcggattttcttaccatttacattgtgatagaatcttttgtaatcctccggactgttaacaatatctttcatctttgcctgcattgcccacggatggatcttgccttcggtgtcttttgcaaattctccggcgaattcttttgcctctgcaagtccctcagaagaataaaagattgccggttcattcatatcgttccagaatccctcgattccctggtcgatcaggaaacggtatttatctccaaaccatttccgggcttccggattcagcatatccggaaaatgggtgtctcccggccacactgctgcaacaaaatcactgccatcttctcttttacagaagaagttgttttttacaccttcctcatatacctcgtagtctttttccaccttgacgccggcatcaatgatcgggatcaggcgaagctcctggtctttcatttcctttacaaattcagggaaatcaggaaagtttttctcattgactgtgaagtccttaaaatcctgcatatagtcaatatccatgtagatcatgtcgatcgggatatgattttcacgatatccttttgcaactgcgcggaagtcttcttttgttgtatagccccaacggctctgtccaaaaccaaaagcgaactttggcggaatgtagctgcggccgatcacatggcggaactgttttacgatatcgtaagcattctcaccttcgatcacatagatatccagatctgcattttcgcaggacactttgagggtgtccattctggtatatccgatatcaaaggtcagttttgacggatagtcaaaaaacaggccaaatgtagtctttccgcttactataataaaattgtgggctccatacagagaacgcttgtcctctgtatgaattgcatcatcagtacagttgctgatatagcagtaacctctcttgttgattccacgattggattcgcccaggccatagacaatgtcatcttcgtccatgatataagtaaaaataaatccatcattctggctgatctctccatatggaaaagcgccctcagctatttcgattttttcggtcaatgcctccgtatcaaacggagctccatatctgtattttctgatcatctctgtgctacctcttattttttataaagtacaaatgcttcatatggtttcaaaacaattttaccttcaaatacagttctgtcaagatttgtgatcagacattctgctcctttgaattcttccggaatctccatctctgcatttttgtcactgaaattgcagactgtcagaagtttttcctgctcctgttttcttatgtatgcaaaaatctgctcgtcatcacggtaaagagtctcaaatccaccataaacaataatgtctttttctttacgcagacggatcagtttctgataataatagaaaattgagttcggatcttcaagctgctgtgccgcattgatttctttgtagttcggattcactttgatccatggagcaccatctgtaaatcctgcctgtgcggaatcatcccactgcattggagtccgggcattatcacggcttctcagcatcagacatttcatcatgtattccggagtcataagacctgattccgtaagctctgtaaagaaatttatgctctcaatatcacgataatcttccagtttgtcaaagtaaacgtttgtcattccaagttcttcgccctgatatacatatggtgttccctgcatcatgtgaagacaggttgcaagcatttttgcagaagtttctctgtatgccggattatcatttccaaaacggctgacacttctcggctgatcatggtttccaagaaacaggctgttccatgctttgccctgaagttcttcctgccatttgatcatgatacgtttgaactctttgaaatcatatttttcagttgtccacttaccataatcaccgcttccgttctcaacatgttcaaactggaataccatattcagttcatttctgaattcacctgcatatttctgtgcctcttcaattgtaactcctgaggtttcaccaacggtcataatgtcatatctggaaagaacttctctgttcatttcctgcagaaactcatgaattctcggaccatgtacgcaatatggtccaaagtcaccataaaggctgttgttcatttctccgtccgggaaagtctggtctttggagatcatactgataacatccatacggaatccgtcgattcccttttcacaccagaatgtcatcatgtcataaacttcctggcgtactttttcgttttcccagttaagatccggctgttttttggaaaacaggtgcatataatacatctgcgtctgtggatcatattcccatgcagaaccgccgaatacaccgccccagttgtttggttcttttccatttaccggatctttccagatatagtagtcacgatatgggttatcctttgattttcggctttcaataaaccagttgtgttcatcagatgtatggttgaccacgagatccatcaggatcttaatgcctcgcttgtgtgcctcggcaagcagttcttcgtaatcttccattgttccgtaatctttgtatatcctccgataatcagaaatatcgtaaccattgtcatcctgtggagactcaagcattggagaaatccacagcacatttacgccaagttctttcagataatcaagtttctgtatgattcctctgatatctcctactccatctccgttgctgtctttaaaacttttaggatatatctgatataccacactttctttccaccattttttctccatgttattaatcatctcctgtttattattttgttaacgaaacctgcgaattactccgcagatttcatttattacttgactgctcctgcaacaacaccgttcatgatccatttctggcagaaaagatatacaagcagtacaggaataagcaccaaccagtaacaaactgacaattttttattattcatcttttctttcctccatgatgttttttagaagtatgaaagctgcgcaggaccattgatctgggaaatgttacctcgaacccgtctgtcctcttccctttcggtgactatatcataacccctgcatcccagtaaaatcaacaggtttctcgtgaaacttataatctatccaaagtttctctcacttttttatatattttgcacaagtccagtttcgttttttctgattttcttcgctatgcaacaaaaaaagaaggactccgtcattctctgacagaatccctctttactaaataaaccggactttttatatttaattctttcagactttctccctgaatcagtttcatcagccgtttcaatgccacatgcgctttttgcctgacatcctgatgaactgttgtcagttttggacgaaccatactcgcatacatactgtcatcataacccgtaatggatatctgatccggaactttgattccctcatcaaaaaggaaattcattgcttcaattgcatcaaaatcagaagaaaaagccagtgctttcgcttcaaggaagcgtggaagaagttctctgtatttcctgagacgcgaatttttttcacccggaacaacgatataacgggaacgactacagaattttccctgcttttccatcgcctgtttaaatcccgtccatcgataatagtcactgtcctgctctgtctccgcaacaaacagggccttctcatagccacaggaatagagatattctccaatctgataccctcctgagtaatcatctacaccgacattctggaaggtataggcaccttcgggataggcatctatcagaatcattttcttattcagcttacgtgaaagactgcggtatctttcttcgttatatccaaggatgatcagtccctcaacattccattttgaagcaatatccactacattctgaatgtcttcgccaccgatgagcatgacataatatcctttttcttccgtttccatacggatgtttccaataagttctcccacaaacggatcctgaagggactgcataccatgagcataagtaaaacccaggactactcctataattcgtgaaccatggccggaaagcatcaccgatcccatatgtggaacatagttctgttctttaaggattgctgtgatcttatcaatcgttttctgagaaactctttttgtatttccgtttatgacatttgacacggtagtgcggctgacaccagccatttcagctatatcctgaagacgaatcatctgttaataacctccttttgtgtgttgcagcgttatgaaagttattcgtttatgaacctgacgggattcgaataaggagtttctgtccgtctttttctgccggcactagcaccgggatatgttttttgcgcagtgcatgtacaattggatatgccgcgaagagattttctccgacaaaaacggcctctggcttatatcgcaggatctgttttacctgttccttgattctggctttccactcctgtttttccatgcttacttctgcatagatgccctgaacttcaacttccggaaaagttggaaaatctatgtgaatgatttctgctgcctgtaattttggaatctggtgaaggagttcatcatattcggcatctccgccaaaacttacaatcactggtttctcgcgaaactgttccatactgatcttacatgcctgtactgcatccgcaagttctccggttgtcataaggaagccgcctttgtggcagaatcctgcagtcttaagtcctgtaacctcctgcagttcttcattctcgagaccaagccattctgaaggaaaactgcatttgtaattcatggagtattcttttttctgaggctgaatgcagtaaccgcctctgttagacggaaagatcacaaatgcaactggcgtctcagaaaggaatttctgacacggcacaaactccggaaggatcagaatctttgcatcctcgcagtgtttttctctgtcatgaaatgcctgcatgtgtctttcataaatttcttctactcgtttatcggcacgctcatttcctctgtaacggtcgaatttgttttccaggatcattccggcaacactgactgcctggaaaaaggcttcgtcgttgcttccttcggcatcccaggttggattgaaatttccgatcagtgacgcaagctcgtttttctcaccggtgttatcattgttgtccagtggctgcacaaaggattcatcgaatttattcgccagttcttcaccgaggatttctgatccaagctcctcccagagaagcccaaatgcggcataggcaatgccgttctcacgaactctgctgtccttctggtgatgatcgtatctgccccgaccgatatcaaatacgataccgtcaaaatcttcaggcacgcggctaccacgtgtgatcgtaatctccggatttaaatatagtaataacgcagccgaaaacacatcatctgcatggaatttaccgctgtgggtgaaagcagttgcgttctgctgatggattttatttagtagattgttcatgtagatactccttaaataattctacgcagccaatgcattggcattgacctgttctattgtttttctgattcccatccatactgaaagatctgtgaatacgtcaacgatacttcccttcaggattttctactgctttttgatttttgccattctttatttcaagaacatctcccacaaactgtcaattttattcttaagttcacctgtaattatcaaaattctttccccctaggtttcatattgaacagtatatcacgataaggtaagcatgtcatgaatttttctgtcccacctccacccatttgacagtccaccctgattgtgctttaatgagggtacaaaaaattaggaggcaataactatgggacttcttataatcagttctatgatggtcttaggcggtatgtatctgatctttgcttttgtatggtggattttgcagatcatcgcaaactggaatatttttaccaaagccggtgaggcagggtggaaaagccttattccgatctacggtgattatgtttcctacaaaattgcctggcagacatcttatttctggctgaattttatccttggaatattactttcttatgtatcaaatgccaatcttaatgaaagcatgtttctctcactgatcgttattctgcttaagattgcgcttacagtgatcaatatcatgtattgcgtaaaacttgcaagagcattcggacgtggtattggatttgcgatcggactcatcttattacagccaatcttcttactgattcttggctttggctctgaccagtactacggtgcagacagataatacagacacatagctcttataatgaacgaaggcatctgagattttctcccagatgcctttttcttatttaatattctgatttgactgcccagcgcattttggttgatctggcgcgtccgttctgggcgcattcctgtgcggatggacgtactacatctttggcataatcggaatagattcctgctttgtatcctgccttgagggcttttttgacaagtttgtcttctccggaatggaaggtcaggattgcaacgcgtccgcctggtttcagggcatccggaagtttctccataaactcataaagaacttcaaattcacgattcacatcgattctaagtgcctggaatactcgctgacaagttttacggacggtatccttcttttctttttccggaaggaaatccagtgttttttctataatctcacgcagttttgttgtggtatccacacgatttcccttgcggatctcgtcagtgatcgcttttgcgatttcctcacagtacggttcatcggaattctcgtacagcattccggcaagctcctcgcggctgatcttgtccagtcgctcggctgcactgattcctttttcctgattcaggcgcagatccagcggtccgtctgcacggaaggaaaaaccgcgcttcgggttatcgatctgcattgaagatacgccaaggtcagcaaggataaaatcaaaaccgcctgcctcttttgcaatctcatcgatcgtgcagaaattctgaagctttacggtcaggatgtcttctccaaagccctgctctgccagacgtttacgggtctttgcggactcttccgggtcgacatctgttgcatacatatgtccctctccgtgcagacattccatcattgccttagtgtggccgccatagccgagagttgcatcgaatccagtctcacccggctggatcttaagaaaatccagaatttcatttaccataatggaaatgtgcattccagccggtgtgttacccttactgataacatgctcgatcgtatctttgtatttctctggatttaattctttatatttttcttcaaatttacgaggatattttcctttatatcgtactcttcgtttgtgcggtgtctgtgtttcctgttccatatcattctccctgtttctgtatttttattgaaaattcgtggctgttcaaagtctgtatagttccaaatcttctgtatcaagattacattttttcttttataaattcttctactatatcaagtgctttttcgctcataaagccgccccagccatgtccagcatttttcagcttgacaaattctacttctttatccatctgttttaatgcctcatataaaatgcaggactgattaaacggaaccagtggatccctgccgccgtgcataatgagaatcggaggtgtttctcggtcaggctgcaaatgaaccacgggattggtcggataaacatcttccgggtgatcatgaagtgattttcccccgatcagaatgcctgccggactggtactggaatcatgatcaatgactgcgggatgctgtactgctgccataagatccgttggtccaaaccagtcaacaatgcagtcgaccccggtactgacttcaggatattcctccggaagatactttgtattacctgtaattcctgcgatcaaagcactgtgggctccacttgaatcaccccagagagaaatcttatctgtatcaatatgataacttcttccatttaaacgtaagaaacgaattgctgttttaacgtctattacctgtgccggaaatggagccagatcgctttctctgtgctctacgatcgcaattgcataacctctttcgcacatccgtgccaaagtgggaagactctgaaaaagattctgtttgtgccaggaagaaccctgcacatatacgatcaaaggccatttcagatcctgtccgaatactgttggtgtcatgatctgaaggtgtaatttctttccactgtgaactgcatattctacatccgtatataattctgtacagtatccaaaggtgtcttctgcttctatttctctgacaccctccggaagctcctcgctctccggaaaatccattttttccataggggacagtatttttttcactttattcctccatataagagtttttgttaatgctgattttaacatccgcactgataaatagcaagcatgacagaaaaagcagtatcattcgcttgtggactgtccccttatttttttcataaattgcctctttattcatgtacagttctattgtaaagtatagtccaagtaaaacatatcaaacagggatgttaattgaattaactcctgggaaaggatttattatcatggcaaacgcaaatgtacagacagcagcaaacgatcaggaggtttcttctgttcagtttctcaccgtaacagcaatcttcgttgcactgacttatatctttactgcattcatcaacgtccgtcttccaatcgcagcaaatggaggactcattcacctcggcaacgttcctctgttcatcggtgcgatcatctttggcaagaaaaccggagcaatcgcaggtggtgtcggaatgggactgtttgacctgctctccggatggactttatgggctccatttactttcgtgatcgttgctctgatgggcttcactgtaggaaagcttaccgaagatgaaaaacaccagaacttcaaatggtatgtgatcgcacttatcgcagcctgtgtgatcaaagtcgtaggttactatatcgcagaagtcgtaatttacggaaatccacttgcaccggttgcttccattcctggcaacctggtacagatcggtgttgcagcagtcatcacacttgttgtaatcgcaccgctgaatgttgcagctaaacgcactggtttaaagaaataagaatttaattaagaaaaaggacttgatcttatgtataaaattatgacaccgggcccgacacaggttgctgaaaacgtgcgtctcgcccgcagcagagaatgcaccaatcctgatcttgatgcaagcttcgtagaattttacaaagaaacctgtgaagagatcagccgtcttctccataccgacaacgaaactcttattcttggcggagaaggaatcctcggactggaggccgcctgcgcttctatgaccgaacctggtgaccatgtccttgtactggataacggtatctacggcaaaggattcgcggatttcgtttccatgtacggtggtatcccggaactctattccagagattaccgtgaaactctcgatgttcaggaactcgaggaatttctcaaagaacatcacaattacaaatacgcaaccgttgtccatggcgacactccaagcggtatgctgaatgatatttccgcaatctgtccacttctcaagaaatacggcatcatgacggttgtcgattccgtatctgcttctttcggtgaaccaatgcgtatctccgactggcagattgacattatgtgcggtggctcccagaaagttgtctccgcacctccaggactgacttttgtagtcatcagtgatgatgccaaaaaagctatggcagaacgtaagacaccgattgcatccttctatgcaaacctgactacttttgcacattattatgaagaaaaatggttcccatacaccatgccgatcagtgatatctatggacttcgtgctgcaatcgacaatattgctgctgacccggatatccttgtaagacacgaaaagatcgccacagcttctcgcaaggcaatcacaggtgcaggactgaacctctaccttaagagtggattctccaatacggtcacggtattcgaagtaccggaaggaaccaccgcagccgccattcttgatggtgtcaaaaacgattacaatattatgcttgcaggctcttttgatgtacttgcaggcaaagtcatccgcatcggtcatatgggaaacaatgctgatttctacaatgtccgcgaagtctttgcagcattggatggaacactcaccaagcttggcgttccgctgaaagcaagcatggaaaaaatcttctgtgacagcatgaaatgaggaatattattatgaacatcccggcaaacatcattcagggtgtcggcggacttcatccatagttcttaaacacgcccaaaaaaggatttcagttccatggtttgatataaaatctccatggattctgaaatccttttttctataatcagataaagtactcgataacttcctccggcacggtctttgtcttttcattgaaaatgagaactgcttctctctcttccaccggaccgagagcatatattatttctttattttcctgattaaagtactgaaaaggtacgatacggttatattccctgggatgtttatcatccatcagaatatctttctgttcaaatggtttatcccagtaataaggatcaaagagaagaatattttcattctgtatacctgtcatcaaaacataatgctcttcctccagatacagacgaacgaccgccacgccaccatggttcaatgcatgattaatgcggctttcttcacttatgtacacgcttctccctgacagatactcgctgctcacggacatgattcccagctcaccatattcattcagccagttgcttaaaaacatcattgcagctctggacgtcccacgtttccctgggatgccctctttgctgtggcagtccagacagtagagcatcatatttcggactgcctccggtgggatttcttcccgttcaaataaataggcgattgcattcatcatagatgtcggtccgcagtcgtattcggataactggtaatgtaatggatttttcatcttttattccttcgtttgtgtccattgtcttcgatagttttctatgtatgtaaggatctgctccggaccatccataaacgcacagagttccatgttggcaacatccataaatttctcgtccgcggtatgttgaagcagagctttcattctatcgtaatagccgttgatattataaagaacgatcgggcgatccagcctgtgcagacttttgagtgtcagaatctcaaaaaattcctcgtaagttccaattccgccaggagtcacgattgttgcatcggaacgttcctcaaggagtttttttcgctcgcgcatagtttctgtaaaaataaattcactgcaattctcatataaaactcccggcttgtcaaagaaacgcggagcaatgccgaggatatacccatcttcagaatcgacgcctctcgctgctgctcccatcattccggtcgccccgccaccaaatacaaggccatgtccacgttttgccatcatcctgccaagttcttctgttttatcataatagatctgctccagctctgcactggaagctccatagatgcatatgttcataatttactccaatcccgcaaaaaacagctcgtaaaaatcatcctcaccctccagcatcggggagttttcccctccaccattggtacttctgcgcatagtagcgtaaaattcttctccagctgtgataagatccatatcgtaaatctcatagcccagttcacggcatttccggcagaatgcgctgagaggctgtgcattctttcgtgtctccagaagctctgcccgaagtttttcgtcacggcgtgctttacttttcagttcgtctaacatttctgtaatttccatggtctcacttctttctcaattctgtggtgttgtctgaatataagataccacatcttctttatataattcaagaagagccttcttctttgcactgacagcaaagccatgaatcttcaggccatttttctgcacaaaattaatcatatcctgatatctgttcggagaatctgtcgtctgtcccatcatggaaaggatatcatcatgatcctgaatgtaagaaagcatactggtaaaatgagtctgcatggtttcttcgtcatttgcctctgccacatggctaagatccgaattgtccagaagcgacagatatggatatttttctctgtcccagcttacgctcattccggatggcagcggacagaaaccaatatttggttctacacaataaccatcctcatcttctgtatgaaccgcacaccagagggctccccattccagttctttctggttggaaagattctgaaaccactcaataaaatctttgtagtccatgatatcattgagggaaacatacgcgaggtaccagtcattgtcattgtaatctgcgattgtttctttggaatcctgaatacttgcttccttacgtgcctctgtatccattttagtttcttttccattttcgtctacttcccacgccgcccatgcatcctcgtctcccggaaggtagaactgcatgatcgggcgactcaatacattattatcataaagagtgagttttcccctcaccaggcggccactgacagaagtaaattttcccgtccagctggaggtctgtggaatgacaatatcgtattcaccgtagccccttgatactgcactgacctgatcacggcgattacctggcagaaacaactcagaatagacagacagatccaggttcattctagtcgtggtcatttcttcatactgaccagctgcttcgtttggattataataaaactcagacactgcttttggtaagataaataccgcgctcaggacgactgcaaggacaaccacccccactgccagtcccattttgataaaagctctgcggataaaacgctggatttcttttatgaattgcctgttgaactcatcctcctgctgatttctggagtctccggcagacttacttttttctattatccgattttctgattgtttttctacgttgtcctctgtcttactgttttgtcgttctgtccactgttttttgtcattcaaatcatcgaaatagtcctgcccactctccagatcagagaaatctggtattgctccttcttcataaagaaattcactgattgcatcctgcttttcgatttccgcttctatctgtttctttgtgctgtcttccagtttcccctgcttatataatttcagtaattcacgatatgtcatttgacctcctcctctccgtcaactctgttttatcagattctacaaacatacctcgtactgtctttacgtttttcacttatctggctattcacttttttaactcttccaaatctttctttaattctttctttgccctatatgccagtacacgcacattctccggcgtgatatgtagcactgccgcgatttctttctgagacatcccaccgaaatactgcatctgaatcacttctcgtttctttacctccaatctgcggattgcctgataaagtattcgtctgttttcttcctcaaggattttttcaagtagatcctcgtctctgtttttctcagggaaacactcctgctcctccattaaaatctcctgggatttctttttttgctgattgtaaaacaggtttctcgcaaccatataaagccatgcccgcatgttcgtatgcccgtccggcagtgccagcagtgctttgagaaatgtctcatgcagcaggtcttctgccagatgcctgtcgccacaaaaagaatacagatacaggtaaagttctttctgataaaggctgtaaagttttaataaaatttcattatccacatccgtattccccctttcctgctttctgcaccggatactgtctgcctgcccactttttccaccggcttttttctctctttcaacaatataacatctgaacacggaaaatgttacaaaaaaattcctcctgtgaaccaactctacaggaggaatcttttatcttattttattgtataggtatgagttctgattcagcagattatttagtttcttctgtttctgcttcttcaggtgttacggtttccggtacagctccgttatgaactgctacaactgtcagtacaacagcttccggatcatccttgatatcaacatctttgtcttttgcaaggctcaaatctttgacacggatagtatcgccgactttcagtccggcaacatctacttctactttgtcaaccagtgctgacggataagctctgtaatttatttcttccatgttctcctggagaacaccatctgctactttgtcgtgatttacgattacaatctcagcaacagaatgtactttttcattgcttaccagtgcctggaaatcaatctcatcaactctgcctgccaatgggttgaaatcaacctctttaatcagtgcatcatatgtctgaccatctacttccagcataacctgacttcctttgtggtcagtttttaacagtttgtcaacctcgttcttcagcatttttactgggatagaaccttcaatctcacgaccaaatacattacctgtaacgtacccttctcttctcagtctttttgccttaacgtccatgcttcttttttcagcttttaaagtattcatttgtcttttcctccaaaaatctgatgcttagcagccttcaactttgttttgtgaaaggaggttttgttaagtactgtttactttttacggttagaagtatagcactgagtgccaaaacagattaaccaaatatcaaattttttcatttaaatttttgttgatattttaaaattgtatacataatataaaattctctgacttttttcacaattacataaaataacttggaaatttcgcggcagaaataaactttttatttactttccatttctttcttctccgccaatatctcttctgccatctcaacttccgtcttttcatccttcggaagaatgatattcagaatgatcgcaaacaatgctgccggcacgatacctgaaccgccgaagatcagattgatactctccggaagctgtgcaagtactgcagagttggaaccaagtccgtatcccacaccaagtgccacagaaacgattgttacatttcttggagacaatggccattttgtaataagctgaataccactgattacgatagatgagaacatcataactgctgctccacccagaacactctgtggcatgatggaaatcagtgccgcaagtttcggaaataagccacatgcaatcaggaaaattccaccaataccaatcgaataacggtttacgactttattcatggcaaccagacctacattctggctgaaagaagtattcggaagaacgccaaatactgctgcaagtgaagaaccaagtccgtcacacataacgccaccggaaagttccttatcagtagcttctcttccaagtccaccttctgtgataccggaaatatcaccaaccgtctctactgctgtaaccacaaacataatgcagatcggcacgatcgctttcgcatcaaatacccatttgaccggcatgatctttggaattgcaaaccaggatgcatctgccactttgctccagttgataacccatgattttgtcgcttcgatcgtagcgccggtctcatctacataggtaaatgttgttggaaggaccatcgccataacagatacaagaacatatccaacaatgataccaagcagaatggaagaaaaactggtaaatcctttagttccatgtttcagtgcaataattacaaccaaaactaccgtacctacaaaaaggttctccagtgaaccataatctggtgcggtacttccgccaccaaaagaaccgataccaacagaaatcagtgaaagaccgattgacaatacaactgtaccggttactactgccgggaaaaatttacgcaatggcttcaggaatccgccaagcactgtttcaaacagaccgccaataaaagaagctgccagaattgctccataaccagccacaccacttcccatggttactgccacgcttctgcagactccgataaatccggaactggttcccataacaatcggtaatttacctccaaccggtccgatcgtataaatctgaatcagtgttacaattcccgcaatcagcatagcattctgaagaagtgctacctgaagttcgcttcctgactcaatgccacagactcctgtaatgatcagaagcggtgtcaggtttccgacaaacattgccagaacatgctgcagaccaagcggaattgccagcttcaatggcggttttccatcaagatcatatggcgttgcagtgtttttttcttttgtttccatactctttcctctctttcaattctcttaccgggcttttacttttcacgttattgagccattccgaaatcatttaccataacatgaaaaaaggaaacaacagttacttcttctttgaagctctctgctatttcctttgaaggtgcgattatgccattctacgcactgagtcttgcctcgattagttcattatatcaaatccatctagcctgtcaaactaaaactttttgtatcctcataaatatttttaataatattcatgatcaatctgaatgacagcgaaatatttactccccggcagttcatgaatcctttctttcagccagttcacgatttcattatctgtataagatgtttttctcggtacctccacatcaaagatcagatttgttctggtcgatcccttcaccatgcggaaatcatgcatactgaacgattcatccagaaaatgtaccatctcctcaacttttgccttcatcgcaaggacctctttgtcatcggttacgatcggatccatatgaatcgttgccgaacagtgcagtttttcctgcagttcatgttcaatatgatcgatctgttcatgaatatcctgaatatctccattcacatccacttcagcatgaagtgagatcattacacgccccggcccataatcatgcacgatcagatcatgcacgccatgtaccattgaatgtcccagcacgatttccttaacctcatcgataaactcctgtttcggcggctgaccaagaagaagatctatggtttccttcagcgtagagcctccggtataaagaataaacaatcctaccagaataccaaaccatccatcaagaagtaatcccgtatatttgctgatcagtgttgcgatcagaaccagcgttgttgcaactgtatcactcaggctgtccaccgatgttgccttcatcgctgcactttctatctttttgcttaaggaatgattgtaaaaaaacatatacagctttacaagaatcgatgcaatcagaatgccgaataccagtgcactgctctcaatcggttccggacttcgcagtttgccgacggaggaccagatcagttcaaatcccatgacaagaattgcaacggacaccagaagaccggaaatatattccattcttccatgtccaaatggatgctccggatccggttcctgtccggaaagccgaaagccgatcaacgtgatgatcgacgatccggcatctgaaaggttgttgaatgcgtctgcagtaattgcaatcgaaccactgatcgtaccggcaagccattttccaaagaacagcaaaatattcagtccgattcctactgccccgcttaatactccgtatgcctgccttaccgatggttctttataatttttactgtccttgataaaaagtgatgccagaaaagtaatcatacacattccctccaaatgatctgccactgtctgctatatgtgtcactattcacagtaatctttatttacgtacagatttgtgtggctttattattcttcgtatatacaaaaatgagactccatgtacagcaaacagaacgttacttttacagtaactttgccatacatgagtctcgttatttaagacaagccagaccagcggtcaggatgttgacttgccacgctgtgcgccactactccctcatatagatatatatgattgattcctgttgatttaatcatatacaggtgcggttagtcaagggaaacatcatctgattcaaaatttcttatccgatcagatttttcaaatcctcttccacggttccaattccgctgattccaaagttatccaccagaatcttggcaacattcggggagaggaatgccggcaatgtcggtcccagatgaatatttttcacgccaagggaaagcagcgccagaagcacgatcacagctttctgttcataccacgcaatgttatacacgattggaagttcattgatatcattcagctcaaaaacttcttttaatttcagtgcgatcactgccagagaataggaatcgttgcactgtccagcatcaaggactctcggaattccaccgatatcccccagatccagcttattatatttatattttgcacagccggcagtcaggatcacggtatcttttggcaatcctttggcaaaatccgtgtaatagtttcgggattttgcacgtccatcacatcctgccataacaacaaacttacgaattgctccggatttgactgcttccacaatcttatctgcaagggcaagtacctgtgcatgtgcaaatcctcccacaatctcaccatgctcgatttcttccggcgccggacatttctttgcctgttcgataatcgcagaaaaatctttttcttctccgatagcacctggaatatgggtgcatcccggataggaagctgctcctgtcgtgtacatacggtccttgtagctgtcctttggcggcacgatacagtttgtcgtcatcagaatcggaccgtggaaacgctcaaattcttctttctgtttccaccatgcatttccatagtttccgataaagttcgaatatttcttgaaagccggatagtaatgtgccggaagcatctcagaatgtgtgtaaacatccacacctgtcccctgtgtctgttccagaagcatctccagatcacgaagatcatgcccggaaacaaggattcctggattttttccaaccccaatgttaacttttgtgatctccggatttccataagtctctgtattggctttgtccagaagttccatcaccttcacaccgtaacttccggtctccagtgtcagtgcagtcagttgatctgcactcagggaatcatccagagtcgctgcaagtgccctctgcagaaatgcgtcaatctccacatcggtatgtgcaagtgccgctgcatgttttgcataagcagccagtcctttcagcccgtaagtgatcagttcacgaaggctgcggatatcttcattctctgtagaaagaattcccacgcgagaagcttttgcttcaaaatccgcttccgttcctttccagagtgctgcttccggaagtacttctcgattttccactttccggatcaattcttcttttgtcgccaatgtatttttaattcgttcaatgatagaatctttatcaaaattcgcattggtgatcgtcgtaaacagattcactatgatcatctcatttacataggcctcaatctcttttccatcgaaacgaagctccgtagtcactgcgcttaatccttttgtcacataaacaagaagatcctgcattgctgctacatccggcttcttgccacatacccctgatactgtacatccactgcatcctgctgtttcctgacattgaaaacaaaacattttattttctttatttcccatggttaaacctccttattgcgttaacgtatattctattttctttgcaaatctaatataatatacattccaccataaagatgtggttataaccacggattgatatgattctacaaaatgaaataaaagaattttccataaaaaaagacagaaccttaagccctgccttgtttatatgcattcatttaaatttttaatcaaaaaactcaattcccatcagtgtcagtccatgtgcgggtgcagtcggtccggaaaccgaacggtcacaggcatccaggatcttctttacacgttccggcggatactggctatttccaacctgaatcagtgttccagcaatgatgcgcaccatgttataaaggaatccctcacctttgacacggatcgttacgatatcaccatcgcgccagatatcgattcccgtcaatgtacggaccgtagatttcacctgtgctcctgttccacagaagctcgcaaaatcatgacgtccgatcagataggaggtcgcctcccgcatcttgtccacatccagcttataatgatagaaataggaatacagacgttccgtcggaaccggaaatttacggttcagaatgcgatattcatatgttttctcgctgtcacagtatcttggatgaaaatccggctccacttcttctgacaactggatccggatatcctccggcagtctctggttcagtgcataggaaatcttttcgcccggaatgcgtgtattcgtatcaaatactgctacatttccaagtgcatgtactcctgcatctgtacggcttgcacccatgatctcaatcttttcccccaaaagatctgtcaatgcatcattgagtacaccctgaatggtaattccattcggctgaatctgccagccactgtaattcgttccatcataggcgactacaagtccaactcttttcatgtttccctccatttatggtaaaaatggttctcgcccttacagcaagaaccatctattcttcttataacccggctacacgaaatccaattgctaccgcaagatatgcaaacagaatcaggtatgcaatgtgatctctctttttgtatttcaacggtttcatctgcgtacgattatctccaccatgataacagcgggcttccatcgccatcgccagatcattggcacgacggaaggctgaaataaacagtggcaccagcaatggaaccatgtttttgactttctggatcagatttccattttcgaaatccgcaccacgggcaatctgtgctttcatgatcttatccgtctcttcgagaagaatcggtataaagcgaagcgcaatcgacatcatcatcgcaatctcatgtaccggaacatgaatcttgtttaatggacggagacttttttccagaccatcggtcagctggtttggtgtcgttgtcaatgtcatcagcgaagaaccaattaccagataaaccagtcggattgccatacggactgccatggaaagtccttcctttgtaatcttaaagattccaaaactcacaagtgcttcccctggtgtcaggaatatattaaacaccatcgtgatcagcaggatcataaagatggctttcagtcccttaaagataaacttcaccggaaccgtggaaatcaggatcattcctgcaaggaacaccgtcgctaccgcataaccggcaattgagtgaaacaaaaatacagaaatgataaaaaccagtgtcccaaaaagttttgttctaggatccaatttgtggatcacagacttcgcaggatagtactgtccaatcgtaatatctctaatcattctggactcctcctttcagcaaggatgagttcatttcccgaagtgcatgcaaaatatcctgcttcgcttcttccaccgttgtatctgctggatctacaggaagtcctttttctttcagggcatgcataatataggtaatctgaggagctgccagccccatctcttcaagttctttataatgtgcgaatacctttttcggtatatcgtcaaaagcaatctttccgtgattgactacgatcaggcgttccacatatttggctacatcttccatgctgtgtgataccagaatgatcgtaatgccgcggactttgtgaagttctgcaatctgatccaggatctcatctcttccctttggatccagaccagccgtcggctcatccagaatcaggatcttcggattcattgccagaactccggcaatcgcaacacgctttttctgtcctccggacagatcaaatggagattttttgaaatttttttctttgaacccaacctgaagaagtgctttcttcgcctcttcttccgcttcttctctgctctttccctggttcatcggtccaaagcagacatccgaaagcacgtcactttcaaaaagctgatgctccggatactgaaacaccagaccgacttcacttcgaagtgcgcgtcgattatagttctctgcccatacatcttcaccattgtaggatactgttcctgaagtcggctggatcagtgcattcagatgctgaatcagtgtggactttccactgcctgtatgtccgatcacaccaataaactgcccatccggaatattcagattgatatcctttaatgcatgaatctcataggaagttccaggactgtatgtgtatgttacattttttaattctattgacataaggcatttaccaactcttccgtagtaagaattccatccggaatatccactccggactgtttcagttcatgtgccagcaaagttacctgtggcacatccaggcgatattttttcaaggtctctacctgagaaaaaatttctttcggtgttccttccatcactacatgaccgtcatccataaccacaacccggtctgcatcaatgacttcctccatgtaatgtgtgatcagaacgaccgtaacattttcctgccggttcagctgatgaactgcctccagaacttcttttcgtccattcggatccaacatggcagtcggctcatccagaacgatacactgtgggcgcatcgccattactccggcgatcgcaacccgctgcttctgacctccggacagtttgttcggtgaatgatgacgataggccgtcattcctgtttttgcaagactctcatccacgcgtttccagatatcaccggtagatatccccatattttccggtccgaatcccacatcttcctccactacagttccgatgatctggttatccggattctgaaataccattccggctttctggcgtactttccagagttccgactctttcgatgtatcgattccatcaatccagatcgtaccttctgtcggaagcagcagtgcattgatatgctttgcaaaagtagatttaccagaaccattatgacccagtactgctacaaattcacctgcctgaatgtccaaatccacaccatcaactgctctctgcgtagcttctacatttccgtcctcgtcatatcttaaatagtcaaatgcaagttttgccgctttgatgattcccatctttctagtcctttcaggcttcttcggaaggctctccaccggtcagagattcgatcagttcccagatctcatctctgccctgctttgtctctgctgaataagggataactgtagttccttttttcagctgaaggccttctcttatcgctttcagattcttctgaacctgactgcgcttcagtttatccagtttcgttgcaatgatgatcggctcatatccgttgtgaaggatccactcatacatctgtctgtcatttgcagaaggatcatgacggatatcgatcaggagaaaaacggctttcagattatgtgaagtatgaagataattttcaatcatctttccccatttttctttctcggccggtgtaacccgcgcatatccataacctggaagatccaccagatcaagttcatcattgatcttgtaaaaattgatcgtctgcgttttgccaggctgtgcgctggtacgtgccagtgctttcctgttcatcagtccattgatcagagacgatttgccaacatttgatttacctgcaaatgcaacctccggcagaccggtatccggaatcttactggtaataccgcatacgatatctaaaactgcactttttatgatcataaaatcctctttcgattatcaggcaagtgcttcatgcagcacttcattcatattatctacaaaggagattttcagtccatcaagaatctcggcatccatctcctgaatatccggtttgttatccttcggtaccagaacctgcttgatcttggcatatttggccgcaagaagcttttctttcagaccaccgattggaagcacatgaccacgaagtgtgatctcaccggtcatagccacatctgcacgcacctctctgccgataattgcagaaagcattgcagttgccatggtaatacccgcagaaggaccatcttttggaactgctccctccggaatatgtacatggatatcattttcctggaaaaactccggtgcgattccatatttatctgccactgaacgaatataagaaatacccgcctgcgcggattctttcataacatctccaagctgtcctgtgagaacaagttctcccttaccaggcattacattaacttcaatctgcagcgtatcaccgccgacctgcgtccatgcaagacctcttgcgataccaacctcatcctttttgtttgccatcagataactgtatctggcttttccaaggtgattctccagattcttactgttgacagtcacctttttctgatcattttccatgatctcacgtgctgccttacggcagatctgtccaatcttacgttcgagtccacgcacaccggcttctcttgtatagagtgtaatgatcttccgaagtgccggagtctgaatcttgagtttgccctctggaattccgtttacttccagctgttttggaatcaggtgatcttttgcaatgtgttccttctcattctcagtataaccggaaatttcaatcacttccatacggtcaaggagtggacgcggaataccgtccatgtcattggctgttgcaataaaaagtacctcagagagatcctgtggaacttctacataatgatcattgaaatgattgttctgttccggatccagtacttcaagaagtgccgctgaagtatcacccttataatcactgcttgtcttgtcgatctcatcaagcagcatcagcggattgctgacaccagcctgcgaaagagctgctgtgatacgtccgggcatagctcccacataagtcttacgatgacctctgatctcagcttcgtcgcggactccgcccagacagatacgtacatatttcttatgaagtgcttctgctacagatttcgcaatggaagtcttaccggttccaggaggtcctaccagacacaggatcggactcttaccgccagatgtcagtttacgtactgcaaggaattccatgatacgttccttcacatctttcagaccgtagtgaccttcttccaggatcttccacgcctctttaagatcagtggaatcttccgatttcttattccacggaagtcccagaagtgtctcgatataagtactcagaacactgctttctgccgcagcattattcatactcttaaatcggtcgatttctttattcagcttgtcttttacttcctgcggtgcatccagtgcttccgctttctgtcggtattcttccgccgtatccgcagtattctcctcaccgagttcttcccggatcagcttcagctgttctctgagaatgtaatcacgttgatttttgtctacacgtgcctttaatttacgctgcaggtcatgcccgatctgcaggacttcaatttcattattcagaatcacagcaagaacttcgtactgattttccagactgactgcttccagaattttctgcttattctgataagtcagtggtacattcacggaaatctggggaatcaactcttccagttctgtaatattcataatctgcgcagccagatctttgctgatctttccactttccatgcaatatctctgaaaaagttcctgaatgcttctgaacatcgcttctttcagagactttgtatactgcgctccatccggctcaaaaagtgccgtctctgctttgagaaacggctcttcctgttccagaccgagaagttctgctcgttcaattccttctaccagcactctgagcagatcatgtggaagtttcacaacctgcttgatataagcaaccgttcccacctgatacagctcagacaactctggtttttctacttccggatctttctgtgtaacgagaaagattttctgatcatgaagcattgctgcctcaatagccttgatcgaacgttcccggctcacatcaaagtgcacgatcatatccggaagaatcgttgtcccacggagcgcaattgccggaagaatgctaattggctgtttcatgtatcttcaatcccttctttaagccgtctccggctttcctgtctttctggaacgggaatttcttcttgtggtattctgctgtacagcaggctgttcaccatgaaccacttccggttctccggttccgtctactgcatcttttgtgatgatgcatttgcatatcgtattatcagaaggcgtacggtacatcagatccatcagggatttttccatgatggaacgaagtcctctggcgccggtcttacgttccagggattttctggctacttctttcagtgcttcttcctggaattccagctctactccatccagttcaaataatttatgatactgtttggtcagagaattcttaggctctttaagaatacggatcagtgcctcctcatccagcccgtctaatgttactacgattggaactcgtccgataaactccggaatcagaccatatttgataaagtcttccggcataacgtccttcagaatttctccgatatttctttcttcctgcacagaaacatctgctccaaatccgatggatttggtatcctgacgggcttcgatcgtcttttcaataccatcaaatgctccaccgcagataaacagaatgtttgttgtatcaatctgaataaattcctggtgcggatgcttacgtccaccctgtggcggtacactggctaccgtaccttccaggatcttcagaagagcctgctgcacaccttcaccggatacatcacgggtgattgatgcattttcagattttcttgtgatcttgtcgatctcatcaatatagataattccatactgcgcacgttcaatatcataatccgcagcctgaatgatctttaacagaatattctctacatcctcaccgacataaccggcttctgtaagtgtcgtagcatctgcgatcgcaaacggtacattcagaagacgggcaagtgtctgtgccagaagtgtcttaccggaaccggtaggtcccagcatcagaatattacttttctgcagttccacatcaagattcttagatgcggtaattcttttgtaatggttatagacagccacagacagagcctttttggcttcatcctgtccaatgacatagtcatccagaatcttatgaatttcttccggtttcagcaaattgatgtctgaatcataaacatcttctgtatcatactgagccagttcctcctccataatctctgagcagataccaatacattcatcacagataaaaacaccttccggtccggcgatcagcttgcggacctggtcttctgacttgtgacaaaaagagcatctgacttttccatctctcattttttctgccataaatagttctcgtttcctttcagtttgatatggcacaaaaggaaccccctgaaaagaggttccttctgtctgctttatttatgctcgacaacaccatcgatcagtccgtatgcctttgcttcttcagcagtcatataattatcgcggtctgtgtctttttccactacttcgtaaggctggccagtgttctctgccagaatttcattcaatgtccgtttggtctgggcaatatgatctgctacgatctgaatctctgttgcctgaccctgggcaccgcctgacggctgatgaatcatgatagtagagtgcggcagagcaaatctcttgcccttggttccgcctgccagaagaaaagcacccatgctggctgccattccgagacaaattgtggaaacgtcacacttgatatatttcatggtatcgtaaatagccataccagcagttacagatcctcccgggctgttgatatacagttggatatccttgctcggatcctctgcttccagaaacagaagctgtgccacgataacgctggcgcttacatcatttacctcttctccaagaaagataatacggtctttcagaagacgggagtaaatgtcatagcttctttctcctctgcttgtctgttcaatgacatatggtactaaactcatatataaatacctccattcgtcgattccagtggtaattcagaacgaacgcttacttaggcttcctttgcttcgtcagcaacgagagttacggctttctgtacagccatatctttcttcatctgctctaactcgcggtcaccaagcagttctttgatcttctccacttccatcttgtatgcatcagccattttcttgaattcttcttcaacttcttcatctgttggctgaatattttcaacttctgcgatcttttcaagaacaagtcttgtctggattctcttcagagcctgcggtttcatttcttcctgcattttctcaagagtcattcctgtgaactggaagtactgttccatagtaagtccctgggactgcattcttctggagaaatcatccagcatctggcgaacctgtgtattcagcatagcatccgggatttccatctgagcgttttcgattgctttatctacagctgcattttcttttgcagcacgtgcttctttttctttcttttctgtcaggttcttcttgatgtcttctttgtactctgcaagagtatcgaactcagaagcatcctgtgcaaaatcatcatccagttctggaagttcttttgcttctactttcttaacgtcacactggaatacagcttctttgccagccagctcttttgcctggtattcttccgggaatgtaacttttacttctacgtgatctccggctttagctccaaccagctgatcttcgaatcctggaatgaaagatccggaaccaagtgtcagcgggtagtctgttccttttccgccttcgaaagcttcaccatcaacaaatccttcgaaatcgattgttgtgatatcaccgttttctgctccacggtcttctactgtaactgttctggagtttttctcctgttctttcttcagttcagcttcaacgtcttcgtctgttacttctgtttcagacttcggaacttctacacctttgtactcaccaagagtaacttccggtttaacagcaacttctgctgtgaagatgaaagcttttcctggctcagcctgtgttacatcgatttccggctgggatacaatttcaaggtcgcattcttccagtgctttgctgtagtgttccggaatcagagcgtttgcagcgtcttcaaggaagattcccttgccgtacatctgctcgatcatttttcttggagctttgcctttacggaatccaggaagagtgattcttccttttgctttctgatatgcagcctgcatagctttctctaaatcttcagcagaaacctcgattgtcagtttcgccatgtttttttccagtttttccacctgtaaactcatgtttcctgttcctccttaattttcaggttagacttcctataatcgtaactgatccagttacttatattctacctataatctttatccctgcgcctgtttcctatagtccaggccctgtatcttctcattaagagatacaattacagtcattatcgtagtatagcacaacgtttttaaaaacaccagtattttttatgaaaaagccctgtttttcctttattttcggctataaaccacagattcggcaatttcatccgcctttttttctcccagaagctgtccgatcaggctaagtgcgaaatctactgccgttccaagtcctctgctggttgtcacattaccatctacaacaacgctctccagtgaacgctctgcacctgcaaggccctccatgcaggatggatatgcagttgctctacgtttttcaagaaaaccaagagatgccagcacggtcggtgcagcacagatagcagctactttaccgccctttttgtaaaagtctgcgagcaggtcacgaagcggctgatattcattcagatattttgttcccggcattcctcccggaagtaccagcatattcgcatccgtgaaatctgtttctgcaaatgtaaggtccgtcagcatggtgattccatgtgaggttgtgatctcttttgatttcttgatcgaaactgtttttatatcaatgtctgcacgtcgcatcagatccaccacggtcagaccttcaatatcttcaaatccatctgccagaaaaatatatacttttttattcatagaaacctccttataaataacatttttgagccatccttctgtcattcagtatagcatttccgtcccaaaagagatatactaatccacaaaataataaatcatttttctcaaaaaaggagtccccaagatggaaatcgaaagaaaatatctgatagaaaaagaacagcttccggagaacctctccgactatccatttcacagaatcgaacagggatatctctgtacttctcctgttgtccgtatccgtcgtcaagataatgaatattttctcacatacaaatcaaaaggcctcatggccagagaagaatataatcttccactgacgcaggaggcctatgaacatcttaaacccaaatcagatgggcttgttatctccaaaacccgttatctgattccggaaaaaaacgggcttacgatcgagctggatgtttttcatgatgattacgagggactactgctcgcagaggtggaattcccatccgaggatgcagccaacgcttacaccgctccggcatggttcggccgtgatgtgaccttctcctctgattatcacaacagtacattaagtaagggcaggagataatttattctttctcatctacattctcatctttattcatatctgcatgctttttgaccggagcatgcgccatatcgtcatcctctgtcatcagaaatttccggatggcaaagaggattgcgatcgcgatcacaccgatcagtgtctgtgatggtttcatatgttccactaccatctgtcgggctgttgcaaacatcaatacttcaacaactgtctgtgctgaatgtctgcagagcatctttacaaactcaactccgactaccagagataacccatttgcaagaaatgttgtaaagaaatctatgtccatgtccatgatctgtatttctgtgatcgtaaagatcaggcggatcccagccagcgcgatcacaatcaaaataatgattgaaagtacgatttccgtatagcgtgcgacattgtatatcccctcgttgaaacatttacgaaccttgtggtttaactctttctgcataaatcctcctgttatttagaataccttcgtagtccatttactcatatcccagacttcatttactacatcctggtagaattccggctcatgacagatcagaaggatgctgcctctgtattctttgagtgcactctttaaggcttccttggcatcgacatccagatggttggtcggctcgtcaagaagaaggacattcgtatctctgttgaccagcttacacagacggacttttgcctgctcaccaccgctcaggacacgaacctgactttcgatatgcttggtcgtcagtccgcatttcgcaagagcagaacggatttcatactgtgtatatgatggaaattcctgccagagttcttcaatacaggtcgtcttattatcacccttcacttcctgttcaaaatatccaagctggaggttttcacctcgctcacagcttcctttcagagacggaatcaatccgaggatgctcttgagaagagtcgtctttccgataccattggttccgaccagagcaatcttctgtccacgttccattgtaaagttcagtggtttggaaagcggctcatcgtagccgatcaccagatcatgtgtttcaaagagcatttttcccggtgttcttccgtagcggaaattgaattccggctttggtttctctgctgccagttcgatcacatccatcttatccagtttcttctgtctggacattgccatgtttcttgtagaaacgcgggctttatttcttgcaacgaaatctttcagttcactgatctcctgctgctgacggcggtatgccgcctcgagctgtgctttcttgactgcataaacttcctgaaaatgatcataatcacctacgtaacggttcagttcctgattttccatatgataaatgatgttcaccacttcgttaaggaatggaatgtcatgagaaatcaggataaatgcattttcataatccagaagatatcgcttcagccatgcgatatgttcttcatcaagatagttggtcggctcgtccagcagaagaatgtccggtttctccagaagcagcttgccaagaaggacttttgttctctgaccaccgcttaagtctgtaacatcccggtcaagccccagatccagaagtccgagtgctcttgcaacctcttcaaccttggaatcaataacataaaaatcatgcagggtaagttcatcctgaattgtgccgagttcttccatcagcacgttcatttcttcctcatctgcgcttccgagaagatcacagatttcattcatgcgctgttctttctgaagcagcggatcaaatgcagatttcaggacttcctggatcgtcattcctttctccaggactgcatgctggtcaaggtatcctgcgtgaacattttttgcccactctactttaccttcgtccggcatcagttttcctgtcacgatactcataaacgtggacttaccttcaccatttgcgccaacaagtccgatatgttctcccttaagaaggcgaaaagaaacatctgagaagattgctctgtcaccaaagccatgggtcagatgttctacatttaatatactcatatagtattctctctttcatttaactgatctatacggactgctgtgcgtatttgcacttctgcaatcctgatatctcgtattatagccgaagccatatggcgaatgcaaccggttttatgtataacaaagcggacaagtcctcttcaaactccctgaatcccgcaatctttgagggacttgttacgctttgcgcgccagatgcagtctgcttcagcagacatattcctcatgcatctggtcgcatcctcgcggagcgtttttatgtaataggaacattacagagtaatttcctattacataaaaaacgaccatacatcatgtacagtcgttttttacagatcactctgcttttattctgtttcgttaaagaccttcttatccagagcgccgttctgatgtgcaacgatcgttgtgcagacagcgtcaccggtgatgttgactgctgttcttgtcatatcaaggatacggtcaatacccatgataagaccaattgcctcaaccggaagtcctacagagttgaataccatcgtcagggttacaagaccaacactcggtacaccggcagtacctacggaagcaagtgttgctgttccgataaccgttacataatccatcggggttaagtggataccaaatgcctgcgccgcaaaaacaacagccacgccctgcatgatggaagtaccatccatgttgatggtcgcaccaagcggaatcgtgaaggaagaaatcttcttggatacaccaaccttcttggaaagggtatcaatagacatcggaatggtcgcattggatgtagcagttgagaatgcgaatgccataaccgggaaaaatttcttgataaaacgaatcggattcaaaccggtaaagatcttgagcaggatctggtatacaccgaaacactggattgccagggcaagcagtacaccgatcatatacttcgccagcggaataaatgcactgaaaccgatatttgcaaaggtacggctgatcagacagaaaacgccgatcggggcaaggctcatgatcatcatagtcatttccatcataatgtcattgaactggctgaagaagtttgctacggtctctgcacgctctcccatcttcgcaaggatcacacctacgatcagggcgaatacgataacctgaagcatacttccactcgccagagaattgatcgggttgtccggaatgatattgaggatcgtgtcagtgagtgacgttgcttccatggtttccacggatgccgcggaactctggatcgcgctcatgtcaagtccgacaccaggattgatcagatttccgacaccaagtgcaacgcaaactgccagtgcagttgttgcaaggtaaaatgccagagttctcacacctacggttccgagcttcttggtatctccgatcgccatacttccgcagaccagagagcagaataccaatggtacgaccagcatcttcatcagacggataaatccctgtccgatgacatacagaatgccctcaacaatgacatctttcttaaagctactgtccggaaccagataacaaagtacaatacccagaattgcaccagcgagcagtgcaataaaaatctttgtagtcagtccgagaacttttttattcggagcttttgcttttacgtttttttctttcatatcaatcctccgttctttcatccatgtactctttcagtgattctttccagtccggcatatcatacacttcaatgatacgaaggataaaattatccagaaccgcgtacggtggtctgactgcagaaaggtctgattgctctgtcggaacagctctcagctctatatccttacctgcaagttttaagatttcctgtgcaaattcgtaccggctgcatacacctctgcatgttacatggtaggttccatattcgttggtgctgatcagatacatgatcatctttgccaggtcttttgcactggtcggagaaccaaactgatcggatgcaacagaaagtccgtttcctgcttctgccgctgccagcacgcggtttacaaagttgtggccaccatgtccgtacacccagttacttcggataacaaaatgcttgtgcgtaaattctttgacatagttttctccggctcttttggatctgccatatactgtcagcggattggtatcatcaaactctgtatacggtttcttgctctgtccgtcaaaaacatcatctgtagaaagctgcacgatcttagatccacatttacgggcaacgatacttaagtttcttgcaccgagggcattgacacggtacgcatgttccgggttcgcttcacactcatcggtgtctgtgataccagtacagttgatgatgacatccgggcggttgactgtaccgaaattgatgacttcatcagtatctgtaatgtccagttcatcaagatctgtgttcagtgcttcaatctgcattggatcaagcacatcattcagggcgcgtccaatctgtccgctggcgcctgcaatccatacttttaacatattattcctccttcataaaaagagcgttgattcagaataaaaatcaacgctttctcaatctttatatcctttaatatgttaccaattcagcatttctctgtcaagaaaaaacacataacagctctgtatatatcattattttggttactgttcacaggtaatatttatgcttctgcactttgtctgaccataaatctgtcagccagtttgtcaattactttattgcagatcacagtataagctgctccaaaaatatttgctccaacacgaagtgcaaccgcagccggcattccaaataatcctgcagcaatggacaatgcaccaaaagtattgaatacagtctgccatgcatatcctgctgaatatccaactccaattccaccaatcataccaatatacggatacattgactccggaagtaccaggtacagcacgataaatatcgcacagcctactatattaaactgccatctgcttcctgatcttgcaacgcagtcttttgtaaatggaaggcatactgacatacaggcaattcctgcccacatagctcttggaagtccaagaagattcataaacagcatcgcacttgatacgatgaatgtcagtttcagataccacctgccacgcgctgaatgaagatcaaattctcgaaacagatcaagaaaggttcttctgtacggtctgtttttctgattcttgtagaaaatgatcatacacaagaccatacctgccgcaaggccttccactcgctttatgtatgatgctcctgtcacatcatagccaagcaaaagcaaatatcccagtacaaaagtggaatgattgtacatgatcacattgtggcatccaagaatcatcagaagaagaattgcaatcacatttactgcaaatgcaggtactggtgacagtgtgtttgcaaaacgtggtgccgtcatcagaatagcaaatattccgacaatagagagcaatccatgtgatgtgcggattccaaagtctgcctgtctgagcacaagcaccgcaagcaggacggttacacctacgacactgttatcatttccaataaacttgctatacagcgataccactgcaacacagaatatcattaccagatagactttgaaattatagattaaaatatgtctgcgtttttctttcgggtcagtggtgtttttgatcagctgcttcgaaccggtcgagctcagctgaagttcctgataaaaagtcataaaactcgctcctttcgtacactagctttcaaattatttttaacaaagtgtagagaactataccgcaaaagcggcgaaaggtcaagaggggattttttaatctggaaaccagagagtattgggggataacaactccttctttctgatattgttccctaatgcctggcagtgcatcttgagctgctgttcaataacttttgcggattacttaattctcagcagtgtatcttcattcgcactttaattacatttgtagatcacttagttttcagcagtgcatcttcatttacatagttaattcgtatgcagatgacttatttctgtcaactatgaacaaacgcatcctcaacttgtattttccatattttgaagatgatccctaataagcaattgtatcttgtttttctttctatagtacttgaggatacttgccgcccgatgattgtatcttgcttttctttctatggcacttgaggatgcttgctgcccggtgattgtatcttgtttttctttctatggcacttgaagatgcttgcagaccggtgattgcatcttgttttttctttctatggcaattgaggatgcttgctgcccgatgattgcatcttgtttttctttctatggcaattgaggatgcttgccgcctggtaattgcatcttgcttttctttctatggcacttgaggatgcttgctgcttggtaattgcatcttgcttttctttctatggcacttgaagatgcttgctgtccggtgattgcatcttgtttttctttctatggcacttgaagatgcttgcagcttgattagctgtatctttatcttgctttctttgcaaattaaagatacttccctacaaatacttgcatctacaatttgcttttctttgatctgcagataccttcttatcccaaatatcatcttcatagtaaaaatactcatcattgcagatacttttcgtagcaatttaaagttcagctacagtagtttataaatatttctctactaatttttctaatatattctgattaagcatactttgttccgtctcaaatgtaagaatcaatcgttccccaggataaatcccatttttttgatataattctatttttcgaacagcatttcttgcatattcttgcttatccatcatcccctcatgttcccaatatatctctttccctgtttttgaagacaaaaatgtaaagtcaggataaacggtgccataccccttcaaatataatggtttttcatacttatacaaaatattctgcctgtaaaaataatctgccagaatcttctcggattttgatcgtactctttctccattttcagttaaaatcataggtgcgccctcttgaaattctttcccttgatatggtgctgcaaaccatttttgaagattattctcccaggtatcctcaattggatttattaatttctttctgtcaggatgcaaggaatcatacatttttttcatttcctcatccgcatctatttccaacattttatttattttagcaagctgctcttctgctatgtttatgatggagctattgtatgccttttgagctaattgctctcttaatatcatatttcttttcggtatatagatgccatttctatcatgtacacaatgataatagcggcatctgtttttgtgctttgatattctgagattgccttccggcatatgctcattctctttttttgcctttgcaattatctcttccaatcgtttttgctcctcacgtaaagcatctttgaatttttgcataaatcactttctcctttattggttttatttattgattttatttgttctctctcatttaatttactgttttccattcgcaaatttatagcttattcaattgctatttttataaaacttaaactatgactcaacttgatagtccttaaatttaaagatacttttttgtatcctgttatatcttcatttgcttctcaattcctcatgtagatacttttgttaataattgtgcatcctcaactattttctctatacttttgcagatattcttcatatatcagataccgataaatgcatccttaatttatcttgccctagacccgaagatgctttgccatattcaattgcatcctcatgttatttttccattgtttaaagatgctttatcattctcaattgcatcctcatgttatttttccattgtttaaagatactttatcactcgcgattgtatccttttcttactattactatggtcctaggataacatccgccattagattttatctttattactttaacttcccttttgaagatactttttttgctattctattttattaatataatttaggatttttttattgaaatttattttaactgatttgaattgtttgaattatgaatgaatcaatgctttgaatatcagaagatattagattaattttagaaaaatcccggaagcatactgctcccgggatagataatacaatattgaacgataaattatcgcttgcagaactgggaaggcttgattttactgaattcttgatatgtagtgttgcaaacacgttacaaacgcacggcttctcattactcctcagaacacctcaaaacctaactataaactttatatcagactcttactctcccctaacttaaatagatactactgtcttaattgaaatatatctacaaaagcttttctttaaaaattccatgttccacatccacactattcattctataaaatgttctatgtaactccccttatcattgcaaaacttctataataaaatggcatccttacaccatacgtgaatcctttattcagcatttaatcccatttcgttatcctgatcgtggctataccaaatcgattctcttttatgttggagatcttcaacatcttgaataagagtataacaagtccgttcaaaatgcggttttaaaattgtatattctgatacaggtctaaatttcaaattattaatataatatgaaactagttttttcacatcttcttcagatgaagtttcctcatcaagaatatcttcttccaaacccatatcataatctttactgtattttatagtattctccatttgtacatctgtttttggaacttcagaattgtctgccgcaaataaatatacatatttacaccctactaattcggatattttcaatatatgaggaacaattatttcccaaaaaacatataccccaaatttaaattctatttcaatatcaggcttataatttgcatccttacacaaaaatttaatatcaatagcaggataggtttcttgaacattttttacaaactcactatcgccagcttgatttgacgcttcttcacgttctttttttatttccgcctgctcttgtgcatatgaaattagtactgttgctctgtctgaatcttcaatcttctcatcaaacaacgcatacgcatcccccaacaattcgtatgcagcatcttgttcttccttgcttaatccttctaaattactctgttttatcgcttttactaatttttctacacattcacgttctacaagtgacatttttatagtatttaattctttatataagattccgcaattaagagcatagtaatatgcaatctttcgtgttctcttatctctaactaaaaaaacttttgtattattattgctatcatcattccatgctttattattaagatattctgcaagtatgttgccactttttgcttgtaaaaattctttaatatcttccttatttgatccatacattcttaaattttcaacaatcaaattttcagaaagatactttttttgcttactaatcgaatccatatgacattctccaaaaaagtcacaggtatcattacctgtgacttttaattcctaaatcaagctaaaactacaccttttcttctaagcatttctcgttttgcatctactctcatagcacgcaaacttaatttttgtgatccattctcattaggtgcaagtccttcccttgcttgcttccaagaaaactcctcatgagataaagaacttaagtcccatgcatcaaatgaatcatatcgttcaaatacagactctactaacctcttttcttcctcagtaagagtttcattaacagactcaaacatatgattacatttatactcgttccttacgctcctaagaacagggccaaatttccaagcttcaaatgaatctccaaacagaggattatttgtgttcatcaatgactccctctgcgaaaaatacatcattttgtgcattttcatttcatccatatcacagccatgtctttcaacattcaattcattcaaatattttgcaacagctaaagtcttgctcatatataaccctcctttcttttatactattatacttctttttttctaatttgaccatatacattttgttgtttttcttactttttatactatacttatgtgcatttttaatgattctataccgtttacgtacctttttctaagaattagacacagataattatcatttatccaattattaaagacctttctctatatctgctgtaagaacaccaaccgtaataccacactagaaatcatactaaatgaaatgatttacatttaacttcataaagccaacacttcctcttcagtactggctttattcaaaaatcacattattaaaaaaacatctgccatactctcatagataacaatgacaaaatataaaacggaagtatatatagtaacctttgcagtcgattctttgctgtatatattataatactctgaatcggtatccatatccaaaggataatactaaataattcaattttatacactatccaataacagagcattgggagtaacaacaagaacattccaataactgacttacattgtaatttttcttttaaagaatatctgagcggaaatccttttttaactaaacgtaattcattttgcacattatagctgacaacattctgtcctaatatcaatatagaaaacaataatacatactcaatatattttccgtctatctgcgataataacattgtgattaaaacaatcgcaaaatactgatacataatctgtttctttcttctgacaatactaaccacctcataaaccatcaaaaaacgatagcggctgccataatatttcttcatcagtcctttcatttctttctgattattttggaagaacacttcatcctgcgtttgcaaaactgtatcatattctctattcaaaaaaccatataacatctgattatattgttgaaagaacgggataattgcttgatagctaaaataaggatataaaataaaatataatccgtaaatgatcaataatatactggtaacaaatacacttccattaaaaaaacaaatcattactactgccaacatacatatattcataatatcccgatatttatattgtgttgataaaaccgtatgcatattgacgattgggttacaaagcatagccacaataaactgtcttaagaccattccctccattggaaaagcccaaaataaaatcaacgcaacacacagcgtcagtaccatgctttttcctatcttcttcactctccaaatatatgttttttctattttccaaatataagtttcaggagaaatacgcattcttggtattgttccaaacaaattcataaacaagaaacaaagaataccatatggtataaaaacagtaatatccattccatagtttttctgaatcatagattgcaatataagaatacatggcacaatagcaatcagtataaaataagcacctatatttcgtttgaccattctaactgcaaatttgaatttctgtttcaaaagcaactgatacatacctactccccttcagataaaatttttgcgatttcctctctgtcaacttcctccatattgatttctctaatttgtccgttatgtaacaaaagacacttgtcacaaacattttgtaaacactctatatcgtggcttgaaataatgtaaattcctttttctttcttgtgaaactccactattacattttctaaaagtttcatttggacaggatcaagccctgaaaatggttcatcaaaaatagtaattttttcttcttgtatcattgcacaagcattatttaaccgttgcattgtaccttttgaaagttctaacggagaatagttctcatatttttttaatcccaacccatctaaaatcctctcgattttatcgaatgcctcttgtttttttatctttctgcttgaagcaatcaaaagaagattttcatatatcgtcaactcattaaaaaaacttggttgatccattgcataggcaaccggcatatcaagataatcaaccttattcatcttttttctgtcgatagagattactcctgtataatttttttcataattcgaaagtatatttaaaagagtagtctttccagctccatttcttccaacaagtccataaatacaagcattttcaaatgtatagtttaagtccgaaaaaacaaccgtttcaccatattttttacttaaatttgaaatctgaatcataaaatttcttttcctctcaaatccattttcgtcagcccaacgactaacaatccaataaaaactactgtgtccacaaataacagtacaacaatattttttaccactccgaaagtaaaaagtatggagaaaatttctaccgacaacacaataaaacacatataatttgtcaaatactctgttataatatcaccataataattgttcatctgtaatttggcataaataaaaggttttaataaataacggattatgatacagctaacgggacaaataaaaatccagtttttattcaccaaagatgttgccacacctttactccattgtaccggaatctctaccggcaacttagaataagacaacgccccaataatcaagcataatactgtaatcgttatccaagtaagcatacttccccatatatacaaaaagctgactgaatccaatttgaaaacagtttgattatctttccaataatcctgcaactctgttacatattgttctacctgtaatttttcataactaatactttcttcatccaacattttttcgcacatgagtttcgccttattcaaatcagtaatctgactttttaatacttcattctgcttctcaagcgtttcctgcaaagttactttcccagatataatacttcgtatatcctcaatagaaattcccaatgtacgcagatatgctatcttctttatattttccacatcattttcagaataatctctataaccattactttcatttcttgaaggctcaacgagtttttccttttcataaaaacggacattagaacgggataaacctgttcgttcttctacatcttttattgtcatgttatgcactcctttcaagcaactctattttatcttaagaataagctataaacaaggtttacagtcaagcatttatccaaaatctcttttcttttagttataaatcaattcgacgttcacagcctctcttgcacacatctgtatattgttcattctcaccacccattccatctgattttctgcctttaactgttccgtgatcccctgcgcctgtttcatctgatctacaatcctttcaaagcgttcctgagcttgttcttctatatctgcaagataactattcagcctactacttgtaagcagaataatataaactactttcttatgttctttcagatagcgtttatgtctttgtccccatacgccgatgaatctttgttcttcttcctccggcaaagcaagacaggggataagataatccccatgtctgatataagtgccacccatttcttcaaatattgttttcttcataatcgtttccacctttcttatcgttctctatccatagattttttcttaactgaccgcttcggctgctgtctgccttcctgctgatagcggtgcagtttttccagtacgcttgcttttttcggttgttctaatggattttctttcttctgctccgtctgatttttccatgcccgcagttcttcattgtattccataattagtgcttctgctttgttataaactttctgaaaggcttgcacattgggatagccttcacgttttacgatctgctccatactcttatgcagacgcttttccaaatcctctaacatttcaattttcccttccaaagattttcgttctttgcctttaaagaaccctcgcagctctgacagttgttttttcaaagaagaaatatcctgctgtgtgcgttttatctcccttgactgtccctgcaagtcatacatgaccttctgcatatctttccactcttgcaaatcaatctttggtacaggtttaggcggcagcttaaatttgaaaatcacttcctgtaaaaagttttttgcccctcggataatctgtcgaaacatatccggcagccaaccgtatgtcctaatagattgtaacgtttcatctgtgattttttcctgcttaatcttcaaaatatcttcttcaggaacgccctcaaccaatgccacatcaactgtccgattccattcctgccttgccgcattgtctgcctttatctcctctgcttttggattgttctttccgattttcttcgttgccagataaacaccgccctgtttgaataccgatagtttttctaattcttcttttacatagtagttaattgtatctgtaaacagttctttcacttctttggtaaaggctttgttcttaaaccattcctctttttttgtgaagatatgactttcatatacttcccctttcgggataatactgcatccggctctgatatttccctgctcgtctaaaatctcttttttcgtgcgtctatgctttccctgctcatcataaaacatatttcgggtggcaatcttcgcttcgggctgttccaacattttccgttcgctgaataccaaatgaatatgataattcgtctttgtcttgttgtgatgaatggctgcgctgcactctacatcatatcttttatgaaaaatctctgtaaaaagtcttaccacatcacctgccctgtactgaacaaaactttcaggaagtgctatgatgaactcacgcccttcaatacatttccctgctgagccgcttgccttaaaatctaactgattttctcttgcaagatttttccaaaattcacgcgttgccccttctgtctgataggtcgcatagagatattcctgtcttttcggattggagatataatcaatccttcctgccacgtcggacagcttactttgcctgataaatgaatgtctgcctataagcatcctcctttcccggctctcgtcgattttattgtgagtaggtgcataggcacctgtttacgaactgattgccgtatccggcataagcctcgcagagcgaaatacacagagtataaaccataggtttgtgcgatgggtgtatttcgctctcaatcgccgagggctgtttttgtattacataatctgattattgctcagacttgcgatttcatttatgggcgtatccgcccttttgatttacccgtatccgggctgctttaacatctgcaacactcccttctgctaaaaaataaaataaattcaaaaattacacgtataagcgtataaacgtatcttccatacttttcaggaacctgtaatcccttgattttcctgaagatatacgcatatacgcttctttggaaaattcttttttatctgtttttcatccgtatcaacgatagctgtctatgcgtatctgcgtatgaattccctgaaatcctctggcattttttccattatctgaaggaatatttgtagaataatgaatgtgatacttcttttcattttcttttaagtaccctgaaaaactttttgcactcataggtttttccgtattatcctcacaccaacggcagtatgcttgataaagattcttagaagtcgctgttgtattttcttccaaacgaatataccctgatgactgcataaaagcgataatgttgttccccgattccatagcttcgtgtagatttttctttgcacgttcactgatggtaaagcggtatttatttttcagtaatcgtttcaatccctccagacaccagagaaaaatatcgtctgcttctctttgcagtttctcaatcagatagggatcatctactctgtctggcggcacatctttgaccgtaaggataatctgtctgcggtaaaatccataggaacgatcatgcaaagcactcagactcccgtttccaaagcagagaaatctgacatataaattaccctgtacgctctgctttgacttcctttccaaatccatcttatcctccagagtgactatggttttaatgtagttggtgtctttcaatgcttccagtttcatatcatcatccaccatcaaaagcctgtattccaaatctgcccttgcaaaacgattatgctctaccttttgaatattgcttacattcatattcgttccgagaatttttctcataaccaaaccgatacgggattttccctctcctccttttcctaaaataatcaataacttctgtgccttattggatgggattaagcaatatcccatatattcctgcaaggtaggaatatcatcttcctccaacagttctgaaagaaatttcagccaccgttccggctttgtttctttcatttcatactttacaggcaatcggttcagacagaattctttcttctctgtaaaatctccattcagaaaataagttccgttattcacatggatacgatccatttgcaccggaagttcttctgaataggcttccagtttaagaacctccaaaagctgttttactttcttggaaattcctttcgtaagaaccggttttaccattctataaatttctttttctacttcgctatctggcagcattccatcatagctgaaaaagataccgttgatacatttcaatggcattctttgcaggaaattttcacaaaatgctacctcatcaatctgcccatcctcaaaccattcctgagagtactctttaaagttcatttctctctgattcaatgcttcttccagtctgttccttgttgtttcgtctatattcttccattcgttcttcaattcttttcacatccttcccactatctagtaaaaattcaattctgtcctgtaactctccaaacaccagtaaatccagatagtaatttatcttttctgtctgctgacaggcttctataaattctgctttccattcttcctctagtgtttttggtgcatagctcactttccattctttcagcagatgaagataatctgataaaatgcggatactttcccgttcccattcttcaaatttcttttcggtctggtacaacgttcttttcggtttttctttcttcttactggtattccttttctttgagctatccgtaaaaaccggtatcccaaaatcttctgccagtttctttgctgcttccaatggtgcaagatgaaagaaatctgccacaaacgtaattacatcccctttcgcaccacaggcaaaacaccaaaatcctttgtctactttcatactgggatgcctatcatcatgaaaagggcaacagaccatcccgtttttactgactttcaatccgtactgctcggcagcctgccttgcagttacgttttcttttactacttgaaaaatattcaattcgactcctttaaaattttcgttgtattctctcagagcctttgatatactgaatttgcgagatagagttatcaaaagctctgagaagttgtccttgtgttacgcaagggctttttcttttccctgcttttttgcctcttcattgaaatatccagtttcctcccatactttacgatcagaacagtaataactgaattcattggaatcgcccatcttcattgccactccaaatttcaaaattccctgctgtattccgatacgaacgtaatgagcatcttttccgattgcttttgcgatttccgtaattggcacatttcttcccgtaaatggtggcaattctacatataatcttttatccattttccacatcctcctttacaatctgactaagttcttgatctaaagctgtagcaattttatatgctacctgcggtgtacagccctttcctgatataatgcaggaaatcgtctgccttgacactccacttaactcagccaatttcttaattgttaatcctctttctcccatcaaaatctgcattttaaatacgtttatcttcattttatttctcctctccttttttaatatgcacttttaatacgtatttttattatatgcacttattctgcacatgtcaatactattttatataaatatgtacttgtaattcgtatttttctatgatatgataagcgtgaggtgaataatgatgagtaatgagaagttacataacaatcaaatcggacttagaatccgtactgctcgaaaagaaaaaggtatcaaccaaacagagcttgcaaatttgttagggaaatcgcttcgcacaatccaaaaatatgaaagcggagaaatcgaagtttccattgctatgctcaatgaaatcgcaaaagttttaggctgcgaatctacatatcttatagggtatgatgccgagagaaaacctttagaaaatctttctgatattatgaatttcttatttcagttagataagataaaggaacttggcttcaatatcgaagtcaaacgcccaccacattatgatggctgggaatgtgctattacttttaatggcaaagatgtttctacggagttaaatcaggatctctgtctattcttagaagaatttgaggataaaagaaatgaagtcagggactatcagacaagtcttgaatcttatcagaagtggcaggataagacacttgcttattacgcaaatgcaaaactgaccgaaaaagaaacagaagaaatctcaaacgaagaacggatacgaagatttcaaaaaatcatgaacgaacggtacggtaagaaagagtcctaatttttaaggaggatttttagaatatgaaattaccgaacggctacggaagtgtagtaaaactatctggaaaaagaagaaaaccttggatggttcgtaaaaccacaggctatcgtattgatccagtcaaagaaaagaaagtaaatgaatatatcatcattggatatgccgccacaaaaacagagggattacaaatactggctgattacaatcggaatccttatgatacgaaggcagccaaaatgacttttgatgaagtgtatgaagaatggtctaagaaaaaatttcctacggtatccgaaagcaatatcaaaggatacaaggcatcttacaaaacatgtggcattctttacaaccgaattttcaaggatttaaaactggcagacttacaacaggttattgacacctgcggaaagaattttcccacattgaagaaaatcaaaatcctgttcaaccagttatatgaatttgcattgaagaatgacatctgcaacaaagattattctacttttgttgaaatcgcccagtacaaagaccgcaatccaaacaagcatacacgtacaaaattcacgaaagaagaagtcgcaaaagtctggacaatgaaagaggataaatactatcagattatcctcatgctgctctataatggcacacgtatctctgaatttcttgatttgaagaaagaaaatgtgcatctggaagaacagtattttgatgtaattgacagcaaaacagaaaacggaatccgaaaagttccgattgctgataagctcctgccttactataaagactggcataattcttgtcctgattgcgaatatcttcttcatacagaggatggcaaaagatttctttatcgcaattactatgacagctattggactcctcttgtggaacagattggaattgaccgtacgccacattgtacccggcatacctgtatttccatgttatcggaagctggtgttcaggatacaacaatcaagaaaattgtggggcactccggtgctatgactttgacagaaaaagtttatactcacttagatatgcaggttcttgtagacgcaatcaacaaaaccttagaaaatgaggatagcataacttccgatataaaatccgcataataaaaaggacactctccagtgtctagcaccgaaaagtgtcctatatttttagatatttttgttgcaaacgtgttgcaaatgcgttgcgaactgagtaaattccaccgctttttaccacatctgacaactccacaaacccttgtaaaacaaggatttgaacgtaaatccgagttccgaagattatcgtttgcgtaactgaaattaacgcttgctgaactgcggtgctctacgagctgctttgagaccgtatttcttacgttctttcatacgtggatcacgtgtaaggaatccagcagctttaagaactggtctgtattcagcatctgcttcaagaagggctcttgcaacaccatgtctgatggcaccagcctgtcctgtgtatccgccacctttaacgttaacgagaacgtcaaattttccttctgtttctgttgcagccagtggctgacgaacgataactttcagagtctctaatccgaagtattcgtcgatatctcttttattaattgtgattttgcctgtaccaggtgtaaggtaaactcttgcgattgatttttttcttcttcctgttccgtagaattttgcgctagccaatgtctcctacctcctattaaaatgttaaggtttccggtttctgagcttcatgtttgtgctctggtccggcataaacgaaaagtttcttgtacatggttcttcccagaggtccttttggaagcatacctttaactgccagctcgataaccttctccggtttcttagccatcatttcttttaatgtggtttctttcattccaccaacataatcggagtgatgatagtaaatcttctgatccattttcttaccagttactttaactttatcagcgttaacgatgataacataatcacctgtatcaacgtgtggtgtgaactgcggtttgttctttcctcttaatacgctagcaacaccagatgccagacggcccagtgtacagccttcagcgtcaactacataccattttctttcgattttatctggattagccatataagtctgcatggttttacctcctgttatttatcaacgataatttgtgtaattacggtcatccgtaatatcatgtataaaattcctggtgaacagtgcaaatctatactgcggaaatgtccgaaaccgctgataaaaacacctttgccggggctttggctcaggagtcatcgcactatgtcacattgggttattctactataagggcattcatatgtcaacagttttttccataatttttacgattttttacgctgtatttcatgttcgatcatccatggtcactttccactgtttaccacataaattccaacacttacaagcagaagtgaaagcaatcccaatattccggatgcctgatctgtttcgcccagcagaagtgccgaaagaagcacgccaaataccggattcataaatccaaatactgtaactcttgaaaccggattatatttcagaagaatgccccagagggaatatgccactgctgaaaccagcgccagataaaccagcagtccgattccacttagtgtcacttttgtaatatgtccgcccataacgcctcctgctgccataagcacgattcctccgataataaactgataagcactgagcatgaccggattaaatttctgagaaaatttctttacaaacaccgaagaaaatgcataagcgatcgtagaaaagaaaatggctccctctcctgcaagactgaactgaaagttcattccattcagattaatcaatactactcctgcaaatcccagaatacagccagtgatttttcttgatgtaatcttttcctgatgaaacaaaaatccggctaccagaatcgcaataaatacattcaccgcttctataatagaagcttttactccactggtatgtgcaagtcccatataaaagaagaaatattgaatgatcgtctgaagcaggcttaaccagataatttcttttgctgcttttctctccggccgtaaaaaacacccctccattacactcccaatcccagctgccagaactcctgccagtgtaaatctgcagccggcaaaaaggatctgcgatgccgtatccgctgcatcaacttcaaacagccgatatccgattttgatacagggaaatgcacttccccacaacagacaacataaaagtgcgccaaaccagacaacaactgttttctgcatccactcctgtttcactttccatacactcataattttctctcctctgctgctatccttcaaaaataatgtatcctattttctcaccgccaccagttcctgtcaaccttgcgaacattccattctcctattataatgataaaataacagctatttttacatctaatttatcagaaatgtagcaaaaccaacacacaaacggaggaatcccatgtcaaatatcaccaaacatgctctggcagaatccctgaaaaaacttcttctcaaaaagccgctgaacaaaatcacgatcaacgatctgaccaccgactgtggcatcagccgtatggctttttattatcatttcaaagatatctacgatctggtcgaatgggcatgtctcgaagaatcacgtaaagctctccagggaaaaaagacctatgatacctggcaggaaggacttcttcagatttttgaagcagtctatgaaaacaaacctttcattataaatgcttataatgcagtcagtcgggaacagattgagaattttctcttccagctgacccacgacctgatcatgagtgtcgtcgaagagcaggcaagatccacttcccttacgcaggaacagaaaagttttatcgcagatttttataaatacagttttgtcggcatcatgctcgactggatccgacagggaatgaaatcagactataccgacatctggaaaaacatgtgcatcacaatccatggaaacatcacaaattctattcaaaactttacaaaacatgccaaatgataagtttttactcattccatattttttgtaaattgaattcaaacacaaatggcaatactataagagacagaaaaggaaagctacacatcatcacaaacaaatgaaaggtggttttttacatgtctaaaaaaggattaaaacttggtgttgcacttgcagccggagccggcgcagcagctattcttaccaaaacgtctcaggaaaataaagagatcaaagctacaaaggccaaaaaagccgaagctgccagatctgattaccgcaacacagaacgcggcaaatatgaaaagaacagcaaaggtatttattatacaaacggtaactacgaagcattcgcccgtccggaaaagccagaaggcgtcgatgacaaaaacgcttatatcgtaggcagcgggcttgcttcactcgctgctgcctgcttcctcgttcgtgacggtcagatgcctggttcccatatccacattctggaagctatggacatcaccggtggtgcctgcgatggtatctttgatccaacacgtggctatgtcatgagaggcggccgtgaaatggaaaaccatttcgagtgtctctgggatctgttccgcagcattccttctattgaaacacctggtgtttccgtactggatgaatactactggctgaacaaacatgacccaaactattctctttgccgtgcaactgtaaatcgcggagaagacgctcatacagacggcaaattcaacctcagccagaagggctgtatggaaatcatgaagctctttatgactaaagatgaagacctctacgataagaccatcgaagatgttttcgatgatgaagtattcaattccaccttctggctgtactggagaaccatgtttgcattcgaaaactggcacagtgccctggagatgaagctgtacttccagcgtttcattcatcacatcgcaggccttccggatttcagtgcacttaaattcacaaaatacaaccagtatgattccctgatcctgcctatgcagaaatatctggaagatgctggcgttgacttccagtttaatactgaagttactaacgttatctttgatttcaaggatggcaagaagattgcttctgcaatcgaatgcaaagtcaacggcgtagaaaaaggcatcgtccttactgaaaatgacctcgtatttgttaccaacggaagctgtacagaaggcacgatctacggtgatcagaaccatgcaccaaacggtgatgcggaagttcgtacaagcggctgctggtcactctggaaaaatatcgcagcacaggatccgtccttcggacatccggaaaaattctgctccgatatcaacaagaccaactgggaatccgcgaccgtcacaactctggatgacaagatcattccttatattactgacatctgcaaacgtgatccgcgtactggcaaagttgttacaggtggtatcgtaagctgtcaggattccaagtggctcttaagctggaccatcaaccgtcagggacagttcaaggatcaggacaaagataaggtctgcgtatgggtttatggtctgttcacagatgtacctggcgactatatcaagaaacctatgaaagactgtaccggtaaagagatcaccgcagagtggctgtatcatctcggtgttccggaagatcagattgatgaacttgctgaacacagtgcagtgtgcgtaccgaccatgatgccttatatcaccgcattcttcatgccaagaaccaagggtgaccgcccggatgttatcccggatggctgtgtaaacttcgccttcctcggtcagttcgcagataccccgcgtgataccgtattcaccacagaatactctgtcagaactgcgatggaagctgtttatggactcctcggtgttgaccgtggcgtaccggaagtatggggaagcgtttacgatatccgtgaactcttaagcagcagtgtgaagctgatggatggtaaatctccactggaaattgatattccgggagccggcatcattaagaaacctctgctccacttcattaagggaacggtgatcgagaaagtattgagagactatgatgtgctgaaagatggaatgtaattctataatgaaacgaaaaatagaaaatatgcaatgtttctataatatgtgatactgcatcagacaatcagatatgatatcttaagaatgcacacatattcaggaaaacaccggaacagatttcataacctgctccggtgtttttctataaagtcacatattctgtcagtaaatttcctcaaacatattttttacagaatcttcttctgtaatctcacagatcaccctcgccggcacacctgctgcaaaagaattcgccggaatatctccaactgttctattcttatgttgattccctaatcaccagttctgtatcaagtaaaagcgatttcatttccccatgaggatcttccatcagttccaataacatctcacaggcagtatatcccatctgaaatttcggctgattgacagttgtgatcgaaggtgaggtcatagaggataactcaatattatcaaatccaaccaccagaatatcccgcggtacatgcaggtgaaaacgcttcgccgcacggatcactgccgctgcaaaaacatcggatatggtaaaaaatgcattcggtctgctgtcagaattcagaagtctgcacaccgctgcataagccatctcatagcttacttccggcagctgcacgatccactgcttcgggatcatgacctccgcgttacgaagtgcattcataaatccttcctgacgtcttcttgcatatttgaagtttcccggtccgttgatcagcgcgatcttacttcctccatttgacagaagatattccgttgcaagttctgcagctctggcgtcatcaatactgacatatgggtaatccgcatggtcattatattcacagcactgtaccagcggagcgatcactcgtatctgattcaggccctcttccgaaacacgattcagaagaatcacgcctgctgcatccactctccgcagaagattgcagaaatccagcagattccctttattcagatgtgattcatggatcagcagatggcatccatgtgcctttgcagatactctcgcaccccggatgatctcctgataaaatacattctcgattcccggaatgttcagaacgatcaacggctgtgtctccttcgaaactgtgactgtattttctatctgacagcccagagaacgcattgcttcctctacccgtcgtattgttggctctttcaccagttctctgtgattcagaactcttgataccgttgccggtgatacctgtgctttctcagcaattaacgaaacagttatcttcttcatactttctctctttttcaggttttaggttaaaatcatttctattataaagcattttgagcctgtttaacagagatatttatgttcctgtatttctactctgtcttcttgaatttctgtttgatctgcggacctacaatctgcaccatgatgacgatcaacagaataattcctttaatcgcgttgttaataagagagtccattttaagggacacaataattttatcaataatcgtataggacattgcaccaaacagaattcccagacattttccttttccacccgacatactgattccaccaaggactgctgctgcgatagcatacatctcataactgtttcctgtcgttgccgggtcagcagaagcattcattgcaatccagagaaaagcaccgattccaacaagtgcacccgcgatcacaaatacagaaattttcacaaccgcggtattgattcccgccatctgtgcacctttcatgttacttcctactgcatatacttttttgccatattttgtacttgttgtgatatatacaaaaacaagtgtcatgataataaggatcagaccaacgatcggaatcgtagatacttttccattaccaaaattataaagtgtctgataagaggactggctgtttgccatcttgtacacagaacttcctcccccgatcagtgctttatccacatgctggcagaaatactgtgcaaaagaacgataaatcagcatcgttgccagtgtaacgataaatgctggcatctggatccatcctaccatcacgccattgatcagtccgcagaatgcgccaaacagaactgcaaataaaaatgtgaggataatgctgtttgtcatgttaaagataatgacagaaaatccaccatctaaagccagcatggaaccaacagaaagatcgatctcaccggtgatgcagatcagtcccatgcccaatccgatgatgccaattactgcagaatgacgaaatacattcatcataccgctccaggtcagtccgtttgttgtcagtgcatatacgataaaaattgccacaaaaacaatgatataactattttctcccaaaaatcctgcgatacgtccaggaactgctgtattctttttactcatcttattttccctcctctgcctgcgccgcatttgttgaatacatcatgactgtcatctcatcaatttcctgatgttccagaactttaatgatctcaccgttataaaatactgcacagtaatcggcaactttctggatctccggtatttctaaagtattgatcagaattgtttttccctgttttgcaagttccaggatcagtttgtaaatttctgcttttgctcctacatcgattccctgtgtcgggttgtccagaagaagaatttctgcatctgtattcagccaacgtgcaagaaaaactttttgctgatttccaccacttaatgatgtaattaaatcttcgcaggaatttgcctttatattcagcatctctttatattttttatatctctctatttctttcttttttgaaatagctggtttccatgcagaaagagtatgttctgacagatacatattttccagaatattcatatctggaatcacagaattttcttttctgttcgaagcaagcatcgcaatctgatctttcatagctgtatgaatagagtgatcccacataactttgcccattgcccgcatctcgccgctgtatgctcttgttacaccaaacatacactgcatcagttcactgcttccggcaccctgaaggccggtcagtccaacaatactgcctttttttactgccagattgatattgcgaaaaccttctccactgaaatccttcagttccaggattatatcacccaacgaccttttttcatatacatcctgatccgaatatttctctccaaccatcatacgtgtaacatcttctggtgtagtatcctttatatttccggcacctataaattctccatttcggaatacggtatatcggtctgacagacggaaaatctccggcattttatgtgaaataaagataaaggaagttccctttttcttcaaattattgacaatgtcaaacagatgtgccacctcatcattgtttaatgatgttgttggctcatccaaaatcagaagttttgctttaaaaaacagtgcttttgatatttcaagtaactgtttctgactggttttcagtttagaaacctgctgcgtaggatcaatatccactcccagttcctggaacagtctctctgcctcctgaatcatttttttcttatcaagacatccaaatttagtcgtatattctttctgaagaaaaatattttcatatactttcagatcattaaacagatttagttcctgatgaacaaaagctattcccaggttttcagactgctttattgtaatatttttcagttccttaccatcaaattctatctcgcctttatcacgcggaaatacacctgtcaaaacattcataagtgttgattttcccgctccattttctccaagaagtgcatgcacctctcctttttctactgtaagctgtacatttttcagtaccggaaccccactgaaggacttacagatgttcttcatctgcagcaaactcataattctcgcctccccgcccgagttaccgggctttttgatacattgctctgatacgcattcatttaattatctgacagaagggaactttacagttcccttcgccatttctgtcttattaaaaagaattatatcacgaaaattactcgatttagaaagaaggataatcttttacgttgtccttatttacgatttcgcaggcaattacgtgatcctgttctacatcttttccatccagataatcaaccatatcctggattgctgtctggatcattgcaggactgtaagttacagatacaataccaccaaactgatctgcgatatctgtgaaggattcaccacgaagtactgcataaagctcatccagtccgccacagcctgtcagataaggtgcatttccgaggaatttttcttttgttgcatcgtcgattccgccgccctgaagagcttcaaggatacccattgcaagttcatcgtcttctgcatagaaccatttgatatctgcgttggatgcatctccgagcagagattcataggctgtctttgtatcagaacggctccagttcatagcacctgaatatgtgatagatttcagatcgtcttcagaccattttgcatcgtctgcaattgtttttccatcgtattccagttctccggtaaggtactttgtgaatccttcatcacggagagttgttacagaagaagtatctccttcgtatacataaactgcatcaccaggttttaatccctgctctgtatagtaagccgcacatgctgcaccgataccttcgttgtcaccttttacgttggatactgcactgtcagctacgccttcaatgattcggtcaaaagctacatatgggatctcagcgtcaaccagctgctggattgcagactgaacagtatcatcgattggctgaataacaacagcgatgttgtcttcaccagctgcgatgatatcttcgatgttgacaatctgttctgctgcatctgcagatgtgatcagctctgcactgtaagttcctgcgtcatttacttcttcgattttttcttttgcgaatgttgctacggaaccagtccagccatgatcttccggagctgtcagtacataaatgtgtgtagcatctccttctccgtccgcaaatactggagtaaccatactacccattgtcatagctgcgatcagcatgcaaactactgttttcttcataattcatttcctccttttggaatatgtttgtttttaataagcggttttcccccgcattatttcagcattttatttaataattcaattattcagagcaacttctcagattacaaactgtctcatatatctcagagaaagtttcaagctgtccagaactctttcttcggaaccttcgaaagatttatcttcaatttcaatacaggtatatccttcaaatccaatgtctgttaatgcagacacatatttgccccaatccacatctcccagtcccggaagctttggtttcatgtactgaagtggatatgccattgttccacactctttcagtttttctttgaaaagtttaatgtctttgtaatgtacatggaagattttatctctaaactcgtaaagcggctggatgtaatcaatcatctgccatacaaaatgagatggatcataattgattccgatataatcactgtcaagaatatcaaagacttttctccagattaccggtgttgtcatcaggttctgtccacctggccactgatctccgtcaaagagcatcgggcagttttcgattgcaatacgaactttcttttcctctgcgtaacgcacgatcggaatccagattttttttaccagttccagattttcttctactgtctttgtctgatctcttccgataaaggttgtaacaaggttaattccaagttttttgcttgcatcgattactttgtataagtgttcaatattggcagctcttttttccagatttccatccatggtattcggataaaatgccagagaagaaatctccacattcttctctttgcaataagaaagaatttcttctgcttctttgtctcccagatttgccacgtcgatgtggctgactcctgcatatctgcgctctgctttggctttcggccagcaggcaacttccacacattcatagccaatctctgaaaccgtatcgatcatttttttgaaatcataatcttccagtattgcactgactaaccctatcttcactctaattcctcctcatctacgcgaacggttcttccaagttcgcttgatttcagacttccgaaaattgctttcattgcactgagtacgcttttccccggaacagccggttctgtatcattttctacagattctacaaaggcatcaatgattcctgattttgtctgattatcatttgtctgaatctgatcaatatcgtagaacacttttcctccatctttgcggatcagttcgatacaatatttcgggtcatgataaatcttgagcattccttctgttccatagatgatcgtggaattatcctcctcaccataatacgtccagctggctgtcatcgttccgatgattccgctcttcattttgtaaatacagatggcattgtcatctactccaatcaggtttccattactgtctttcttatccagagtcgtaacttttgcagttgtttcctctactgtatcattaagcaggtactggatcaggtctgtcttatgtactccaagatctgccattgctcccattgcagctctcttcttatcaaagaaccagttttgcggaccagcatctacactccatgtttccggaccgccatgtccgaatgttgttttgaaagtaagaacgcttccgatatctccacgctcgatgagtttttttgcttctgcatgggcttttgcaaatctctgattctgaccgatcataagttttttgctcatctgctctgctgtatccaccatcatctggcagtcttttaattttgttgccatcggtttttcacaaagtacatgttttccggcttttaatgctgcaatcgtaatttcagcatgcacatgatttgccacacatacactgactgcatcaatttccggatctgccagcatctcctcaacgctttcataagacttacagtcatatttttcagcaagttcttttgcccgctgcagattcagatcataaaggccagtcagctttgcattcggattatccagatattccggaatatgacgaacctgtgcaatctttccacatcctataatcccgacttttaccatctcattaccccctttatgatttcatttttctttcaatctttgtttcatttttcatttaaaacatatcatttttcagaaatacagtcaatatttttgtgctatacgtatattttttctatgttttgcatctttttattattcatttttgatgtttattaccatgttttatgtttcatttctgaaaacttttcattcttttcatttttctaccaggtagcagacatattccatctgcatctggtcgcatcctcgcagagcgtttttatgtaataggaacattatggagtaattttccattattacataaaaaaaagacacacatctctgtatgtctctctgtcatgtcttatcgaatatctttcggatattccacaccttccggcaatggctgccattcgttcagcccaaggctctgcttaaacttagcctgttcaagtgtcagcttcggaagatcatcctgaagatatgccatcaattcaggaataccctcacgtgtaacattattcacctcaaaaatatgctcacatcccatattctgcatccactgacgaaccattggtaaattagcatatggagaatcaacctttgtaataataccgatcagcggtctcaaaaggaaacatctgctgccatcactgaataagttgaatggttcatctgccgcctgcacgattgcaacaacatctgcctcaaaagaaaaacacgccagtccgacgctgaaatgcttggattctgcgtattctcccggtgaatcgatcgtatcttcatttgaatttgtatactgggttttgtgataatgtaattcttcacccttcaacgcctgtgtcaaagaagtcttaccagcttcacttcgccccattaagaaaacttttttcattctttatcctgtcctgttatcagcttttgtgaatctcacatacatcgaaatgcagctcatcacgaaaaaatttcacaacttcttctactgcggtcatcacctgcgataaaccgccaagtataatcagagctccactgaaacgatccataaatcctacctgaacatctgccgccttcactgcaacatctgttgcaaccacaatggcctcccatggcgtaacgcgcataataccaatggattcacctgtatgatcttctccttcgtgaacaccgatgttaagtgccaggttctgataaacagccggatctgaaggagtgattacatgtgcaaaatcaagagacttacccggaacccgtacacgcgtcagacgaagtttctttcctttcagcttctcataatcgtcattaaacaatttctcgagaagctcttctctcgttattcgttcttccatgccttacttcctatctcttggtaatattgcaaaccacatatcccagtgtatcacggaaataatctacgacttccgtcattgcagacataacatctgagatttctcctgtgataatcatcgttcctgtaaaacggtctgcaaatccaagatatacattgccactcttcactgcgatatcagatgcaataacagcggattctgacggtgtcatattcatgattccgattgcagaagagcgatagtccacctgcggattcagtccgagtttctgatatatgatcggagccgggccacccattacatgtgcaaaggtaatctccttacctgcaaccgtctcctgcacgattctgatctgatcgttatgttcatttgccattgatagctcctcactttcaattaatatgaatgctcactacgtatattagtgcaaaatactacttatctaatagtattaattgtactattttgtacacataatgtcaaggcgattttctatcaactcagcacgaaacaactgtttttgtttttaaaatccacacaaaacaacattatttttttccctgacaatttaaaatgcaccaaaaaacaactgtctcggatttctccaaaacagttgctttcctgataaatatatcacttttttctaaatcagcttatttctgatacatatctgactggtcgctgtcaaaataattgattctcatagatgccttgacatcattcaaagtctgggctgcttttgcttctgctactctgctgccttctttgagaatttccataacatccggaatacgctgttcccattcttttcttcttgcacgaatcgggctcagctctgcctgcattacattattcaggaatttcttaaccttaacatcgccgagaccacctctgcggtagtgatcttcgagctcttcgaggttctggtattccggcaggaattccgggaaatactcatccttacagaatgcttccagatagataaataccggattgccctctacgcggccaggatcctgtacccgaagatgattcgggtctgtaaacatggacataatcttcttcttaacatctgcttcctcatcagaaagataaatacagttgccaagagacttactcatttttgccttgccatcgatacccgggagacgtaaacatgccttattggatggcagcacgatcttcggatctgtcagagtctctccataaacggtattgaatttgtgtacgatttctttacactgctcgatcatcggcatctgatcttcaccaaccggtacatgcgttgcacggaaagctgtgatatctgctgcctgactgattggataacagaagaaaccaaccggaatgcttgcctcaaagttacgcatctgaatttcagctttaacggtagggttacgctgcacacgtgcaaccgtaacaaggttcatataataaaaagtcagttctgtcagttccggtaccatagactgaataaagattgtagattttgccggatcgatcccgcatgccagataatccagtgcaacctgaatgatgttctgacgtactttctccggatgctctgcattgtctgtcagtgcctgtgcatctgcgatcataatataaacttcatcataatcaccggaattctgaagtttgacacgttctttcagtgatcctacataatgtcctacatgaagtcttccggtaggacggtcaccagttaaaataacctgtttcatttatttcttctcctcagggcactctgtcgaatcctgcggtgcctctttttctatagtttctgcctgttcttccggctgttctggggattccttttcgagatcccgcaatacttcttcgcagccttcctccggctctctttcttcaaacggaacgaagtttgcatgatgtcccacatatttatatgccggacggataatcttgctcgcattgaggatttcctcaagacgatgtgcgctccatcccggaatacgtgcaattgcgaaaattggtgtaaacagctctttggggattccaagcatagtatatacgaaaccactgtaaaagtctacgtttgcgcagacatttttgaaaagtctccgctgttccatgaccattcttcctgccagacgttctaccagttcgtaaagggcaaattctttcatcattcccttctcctgtgcaaggtctctggcaaaacgtttcaggattacttcacgcggatcagaaagtgtataaacagcatgtcccataccatagatcagaccggtatgatcgaatgcttctttattcagaatcttgcggagatatgcttctacctctttctcatctgtccagtctttgacattcgcctcgatatcctcaaacatgttctgtaccttaaggtttgcaccaccatgacgaggtcctttgagcgaaccgatagatgctgcaatagaagaataagtatctgttccggaagaagtaactacgtgtgtcgtaaaagtagagttgttaccaccaccatgctctgcatgaaggatcagggcaatatcaagtactttcgcctccagttctgtgtatttgccatccggtcgaagcatcagaaggatgttttctgcaagtgaaagccctttctgtggattacggataaacaaagtctcatcacgacggaaatgtctgtaggaatgataggaatatactgcaatcaaaggcagttttgcgatcatttcaatgctctggcgaagaacattttccgcagaaatatcttctggtttggaatcataggtgtacagagtgagaatacatctctgcattgcattcatgatatcaccgttggaagctttcataacaacgtcacgcacaaaacgtccggacagagtttcaaagttttccatgatatttttgaatatttccatatctttatctgacggaagtcttccgaacagaagcagatagatggtttcttcaaaaccaaatttacgtcccttaagaccatctacgatatcatttacattatatccctgataatacagtcttccatgtgccgggatcttacgtccattaataagatcgtaacctgttacatctgaaatctcggtaagccctgtcaggacacctttacctgcggagtcacgcaggcctctttttacatcatattctacatacagattcgggttgatccggtgaccattcatcagttcttccccaagcaattccatgctgtctttcaaattgcccatctcttcaagattcaacatctcatgatctgccatttgctctcttcctccatctctatttctattctacaaaggatttccggccgatgcatttacagcttcgccagaattcacgcattcatgcgttactagactaaattgtattctattttacacgaatataccctaaaatacaatagataaatagagataaatcaacaaaactttcgtaagcaaaaatttcacagtataaaattgtcgtctagccccgaatcttctcttcccactctttctcgcgaaatcctgtaaggacgaaatcttcacctactacaagcgggcgtttgacaagcatgccatctgttgccagtaatttcagctgttcatcctctgacatctccggaagtttatccttgaggttcatctgcttgtagagcatgccactggtgttaaaaaatttcttaagtggcattccacttttttcataccattctttcaattcttcatatgtaggattttcctctatgatcgggcgctcctcgaaaaaaatcttgtgttcatcaagccattttagggctttctggcaggtgctgcatttgtgatatactaaaactaacatgatgatttcccctatatgtcaaattttgagtctctgtaaacagttacctcttttgttctatgatatcccactgccctggtactgtcaacgagctttttttgtaacattttgtcgaatctgtccattctatttttttccgaacgactctggtattttatgtatgaatctgctacaatatgttgcagttatttaacttactgcttacgaccattgcgattctggccgaatgcatattgcaaactaatccatcttatataaaggaggtcccatcatgggttatgataaacttgaacgaaatctgatcgacatcatcaaggaagaacaggcgaaactcggtttctttaaagaagatatccgtctgtactatccgctttcttccctgaatcattttttctctgccacagacaatgcagacgagatgcaggcccgcctgaatgccttaccgacatccatcacagaaaagcttggacagatcgaaatctctcacaaaggagatcgtttctgttttcacatcccaaaagaaggaaccgtctatgtgcatgataacaccgcaccaaacgaattcatcaaaagtcttgtggaattagtagcaaaacacgactgcacgatgaatgaaattctggatctgttccatacttattcacagaacattatcacagaagaaataaacaacgacgaatttgaccgtctgatccgttttgctgataaaccagaagacacttattactattgtttcaaagacgaaggctgccatatcatttaccaccgcttcctgccggaagattacgcagacttcgatttctaaggaggaatgcttatgtgtacagctgcaacttataaaacaaaagatttttattttggaagaacactggactacgaattttcttacggcgatcagattacgatcactccaaggaattatccgttttctttccggcatgccggtacaaaacaaacgcactatgcgatcatcggcatggctcatgtagccggaggttatccattatattatgatgccatcaatgaaaaaggtgttggcatggcaggactgaatttcgttggaaatgctgcttatgccaatgtaaaaccggatgtaaccaatgttgcccaattcgaattcatcccgtggatcttaagccagtgtgcttctgtcgcggaagttcgcacacttctttcccacatgaatctggtcaatactccattcagcgaacagtttcctctggcgcagcttcactggatcatctctgatgaaactgcatctattacagtagaatccatcgcagacggtctgcatatctacgataatccggtcggtgtactcacaaataacccaccttttccacagcagatgttccagttgaataattatatgcacatttcttcaaaacagcccgtaaatacttttgcagatgatctgactcttactgcctacagccgcggaatgggtgccctcggacttccgggtgacctgtcttctgcttcccgttttgcacgtgttgctttcacaaagatgaattccatctccggagattccgaagctgaaagcatcagccagtttttccatattcttggctccgttgaccagcagaggggctgttgcgaggttactgagggaaaatatgaaatcacactctatacatcctgctgtaacgcaacaaaaggaatttactattatacaacttacgaaaaccaccagatcagtgctgttgatatgcacagagaaaatctggatggaactactttaatctgttatccggtcattcagggtgagcagattcattttcagaattaggaggcacaacacatgaatcttggaaatttaatgcagttaaaaaattcctgggcaacctttacccagaatcatccgaaattcccgaagtttcttcaggcagccagcacagctgtcaaagaagatacactgattgagatcaaaatcacaacagctgaaggaaaagtgattgagacaaatctcaaagtaaaagcgtcagatatcgagcttttcaaaaacctgaccatgtgatatactgaccacagattttagaatatgtacaaaagaacaggacacaaaagaggacttctccggtaactgttcagaacagcatcttctctgcattcatgttctacataatctgtggacagttcttgtctgacacaaatgataaaataaaatctaaagggacattacaaatgtatgttattattacatctgcaatgccccttttttataatctcacccgttcttcttttccatttgccacacggaacgctctcggcgtcgtatggtagcgttctttaaatacccggtgaaaataactgccattctcatagccaaccgctgcaatgatgtcactgatcggaagatctgtctcgcacatcagttccacagctttgttcagacgtttgcgctgaagcagttctttgaaattaaatcccgtatttttccggatcatcttactcagcatatgcatcggcaaatgcaatttttcgcagagttctgtaagtgtcgccgttttgtactgctgttcgatataatccagcgttgtcattgtgatcatgttttcatactgattcggcaggcgcatctccgcatactgtacagattccagaagatagaggaaaatcaatcccatcgttgtctggttgatccgattctgatcgcctttaccggtcacaagagagtagatcatattttccagaagattctggatctgcagcacttctgcaaccttaaaatgcagatattctccacgctcttcatcttggcgcagcacattgaccaggaaatctgcaaggacattattattccccgccatcgtataggccacatcaaaaaactctggaaggatcataaagttgattgcaatatcttcttcccccgccggcagaatctcatgtctcgtatactggttcaaaaacaacagttcgcctgcatggatcacgacttctttaccacctataatatttgtaagctgtccctggcagacataaagcacctcaatataattatgcctgtgcgatggaaaatgcacaaatcgtgtatgggtacgtacagcgatcagtttgccctcactgagcattttcgcactgtccaccgtgaaatccttcccagatgtataaaggtccttatctacctctgcaaccccatccaggattctctgttcttcttctgttacaactcttaaatgatccaataaagcctgctgcatctgttactcccgctttcttcactgctataattttgctccggtaacttatttcttttattctaccatgctcagacagtataaagcaatatgacaaaaaagtacacaaaaacagagcgaagcctttcggctccgccctgtcttttaaggatttatcatattcagaaaaacttttgcttctccaagcgtgctgattagtacagtttagcgtagtcagctacgttgtctggtgtgaactgaagtggctcaccaagaacgatttctgttccttcatcatcagcttttgtgattgtgaattcacccatatcgccagctgtgaatgtttcatcttctgcaccagtgatgtcaccttttacaagtgccattgttgcatatgcggaaagttttccaaggccttccatatcccacagatagaagtatgggcaggaatgtgcatcgtcatcacctgtgtactcctgcatttcagaaggaagtccaagacctgtcagtttgcaagcagattcgttgtcctgaaggtatttagcagctgcagcgataccaactgttgtaggtgcgcagataactttcagatctgggtagttctgaagaagagctgctgtctggtctgtagatttctgaggttcgtcatcaccataagctacttctacaagttccagtttgctgtatttctcatcgccttccatgatggatttcatagcgtcgatccaagcgttctggtttgcagactgagatgttgcagaaaggatagcgaactgtccttctccaccggagatatcaagaactgcatccataagagcctgtccaactgcctgtgtaccagcctggtttacgaatacctgacggctgtctttattcggagcggagtcgaaagaagatactttgattccagcgtccatagcttcttccagtttagcctgaagagcgttaacgtcatttgcggagatgcagattgcatctggctgctgagagatcaggttgtcaagaactttgatctgagcatctgctgttgcagcttccggataaacaacatctacagttgcaccttcagcttctgctgtttctttgaatgcttttgcagcgatttcgaagaatgcgttacctgctgattttccaaccagtgcgattttctgtccgtctccggctttgtcagctgccattacaggtgctgcacagctaagtaccattgctccgcaaagaagtgcgctgataatttttttgttcattttgttttcctcccttggaaatatagtttttatttgcaactgctcccctgctacaagagagcagccacttacgttattaaataaatatttagtttttcttcatgcttactgcttttttaacatttccgatgatgttcggaagagctactgcagcgatcagaagtacaccgatgatcagcaggataacctgtgcattgacgtttctctgaccaagacctactcgaaggcatacaatgataaatgcggaaataaatccacctgcgatattacctttaccacctgtagaggaaatacctccgaatactgccattgcgatggcatccatttcaaatccgttaccggttgttgtatttgcaccgtatgaagaagaaaccaggaacagtgcacacagtccggaaacagtacccatgattgtgtagatgataaaacggatcttctgtacatgtacacctgagtaatatgctgtcagacggtttgtaccgattgcatatacacgacgtccgaatgtactcttacctaaaacaattgcaaagattacagaaaggatcagtaccaggaacagaatgtatggaacatttccgatctttccaccgatcgcacggaagccatcagtgttacttgcagaaatacttccaccgcttccaagaacgatctcggaaataccacggaagatgatctgtgttgccagtgtaacgatcattggaggcagttcctggaatttggtaaggataaatccgttaactgctccgcagatggtaccaacgccaagcgctgtgatcacaactacgataaatggtgcatttgtgttgcacacgatacagctcattgttgcagaaaggcaaacaatcgcacctacggagatatcgatctcaccaagtaccaggatgtatgccatcggcagcatcatgaatacttctgccagataaaccggcatctgacgaagcagactgctcaggttataatattcagaaaacattgcacagaaaatattgactgcaataaacagcaggaccaatattccttcccaggagaagatcattttcttcactgggctctccggcacattattaatacttcttccagattttccagccatgattacatctcccttcctttcagtgcattcttatcagcgatacgctgcaggattacattcattactactacgacgaggatgataatacccttgatggtattcagccataactggttgaagaatggaatcagcggaagtgcttttgcaattgttgcaaggatcagggatccaagtaaagcaccgattacggtaccacgtccaccgctcatgcttacaccaccgataacgcaggctgcgataacatccatctcaccgccatactgcatatccggcattgcggatgcatatacagaaacctgaagagctccgccaagacctgccagaagacccatgatcgtataaacaagaagtttgatattctttacgttgataccggatacttctgctgcactcgggttactacctactgcatagatcatacgacctgttctggtccatttcataaaccagaagaagaatacatagcatacaatgattacccagatgactgcattcagtccaaggaattttgttgttgcaaaattcttaaagttaccaagtgctgctgcacttgcccattcaccaccgtgggatacctgataaccaagtgcacggtagatatacataaagcccatggttgcaatgatcggaggaacatctgctctggaaatgatcagaccaacaacagctccacatacgataccgattgcaattgcgatcacgaatgcgaggaatgtgctggagatatgttcatatttcagaagcataccgatgctcataccggaaagtgcaagtgttgacatgatagaaatatcaattccgccaacaagcattacacacagcataccaagtgacattaccattgttactgcattgtttttcagcatatccatcagtgacttaggagtcaggaatgatgggttgattgctgtaatgattacaaaaagaacgatcaggacaactgcaagcagtgcttcacgggagcctgtgatcttcttcatgactgatttcttttccattattcagcaccccctgtatgtcctttttccattgcgagttcaaggattctttcctgtgtagcttcgccacggttcagctcgccggtcttacgtccgttgcacataacaacgatacggtctgccataccaaggatctctggcatttcagaagaaatcaggatgatcgcataacctttctttgcaaggtcgcccatgatcgcatagatttcagcttttgcacctacgtctacacctttggtaggctcatccatgataacaactttcatttcctggcttaacgccttggcaacaacaactttctgctggttaccaccggaaagagagcttgccggctggaagatatcaactgcctttgtatcaacttcttcaagaagttttttggcaagatcacgttctgtcttttcatcattgataccactcttcgcatatttgctgatggtaggaagtgttacgtttcttcccagtccccagctcatgatcagaccttctttctgacggtcttccggaagaagaatgatacctttttccattgcatcggacggttttttgatgtgaacttctttaccttcgaggtaaaccttaccggaatccggctgtgtgataccgcagacagcttcaacggtttcggtacgtcctgcacctaccagaccggtaagtccaaggatttcacctgcacgaactttaaaagatacatctttgaaataacctgttctggaaagattttcaaccttgagcatctcatctcccagtttcacttccggtttcgggaacaggtctttgatctcacgaccaaccattgctttgatcagatctgcatttgtaattccatctacatcgtaagttccaatatactgggaatcacggaatacagtaactctgcttgccagacgatacatatcctcaaaacggtgagaaatgaagataatggaaactccgtcagcttttaatttatcaaccagtgtgtaaagtttttcggattcggatcttgtcagtgctgcagtaggctcatcaagaatgatgattcttgcattggtggacattgcttttgcaatctctaccatctgctgctgagcaacacttaaggtacccatttctgctgttgcatcaaaatctgcatccagctgtttcagaagtttgtttgcttctgtgttcatggctttccactggatcattctgtttttgatgatctcatgtcccatgaaaatattttctgcaacggtcagatgcggataagatgtcggatgctgatatacggctgcgatacctgcggcctgtgcatctttcggtcctttgaaatccaccttctgtccatttaagaacatctcgccttcttctgccttatgtacaccggtaattactttaataaatgtagatttaccagcaccgttttcacccataagtgcgtgaacttcgccaggttttaactggaactgtacattgttcagtgccttaacgcccgggaaaatctttgttatgcctttaagttcaagaacatattcagacacggctctttcctcccttttcttaaatctgttattattataacaataaaactttctatccaaaacaggaaaatatttcgaatcggggtaaaatattttcctgttaatgggtaatattttccagttatcttcccaaaacaggcactgtcattagtaactgttcacagcaagcgttccatgacattgacatgagtttttgcatttgttatagttactatatatttattactgaagggaattcgtgcaaaaatgagctttcttggcaaagtaaaaaagaaactgcgaaacggcagctggtatcctttttacaatacattctatgaaaaaaataatctggatccccatatgatcctgctggaatccagaagtggcaaagctctggagagtaatattctttccttattaaaagagctctgtcaggaaccctatcgcagtttcacacttgtactgtccgtccatcgtgactctgaaaatgaaataaaagagaaactccagaagaactccattcagggagttcgttttgtgcgtaccggttctgttgcttattaccacgccctcagccgtgccggctatcttgtgaatgatacctcgttcccgggacgctttataaaaaaggaaggtcagatttacctgaatacctggcatggcacgcctcttaagaagatgggacgtgacaatcgtcctgagatggtaaccatgggaaatgtacagcggaatctgctggattctgactatctggtatttccaaaccagtttatggaagaaaaaatgtcaggagcctatatgctggacagtctgtaccgcggaaccgttcttcgcgagggttacccacgtaacgatatctttcgtcagccggcaaatctccacttaaaagagcaggtcggtctgcagggcaaaaaactgcttgcctaccttccgactttccgtggtaattttgatgctctggacgatcagggatatatgcaaacgctctctcaaaatctttctctgtgggattcccagctgaatgaggatgagattcttcttattaaattgcatccgttccttcatggtctggaagatttttccggttatcatcatattctgccatttccggcatcctgggatacttatgagggattgagtgtctgtgatacgctgatcacggattattccagcgtgttttatgattatgccaactccggcaaaaaaatcatactttttgcctatgaccgcaaggaatatgaaagttcccgtggtatgtatgaaacaatcgattcctatccttttgattataccgaaaaagcagaggaggtcattccatttgcacactgctccggtggcacaccggacaatgcttttatgcaaaaatatgccagctatgaagacggacacggtgccgaaaagatctgtcgtcaggtcttccttcatgaggactgctgccgcaagtaccaatatcatggcaatggtaaaaaaaatattctgatctatgcaggagacctggatctcaacggtatcacaactgtcctgtattctcagcttcatgaactggatcttacccgttataattattttatttctttccgttcactgtacgtaaaagatcacccggaaaggatggaacgcctcccggaaggcgtcgggatctatccactggccagtgaaatgaatatggatctgctgacaatggctgtccagcttctgaaactgaaaggccataccggttcctgggccgaacacagactgcataccgcttacagacgcgaatggaaaaaacatttcggaagcactgaatttgcctgtgtaattcattataacggctacgaagcctatacaacttcacttcttgaagaggctccatgcccacgaagtatctggattcacaatgatatggcaagggaagtccacttgaaaggcaatatgaacccttatcttctgaaagaggcatatcatacctatgaccacattgtaccggtgagtgaagatcttatccagcctgttgtcagtgaattcggtgctgaccgttccagaatcacggtcatacacaactgtcacaattatcagagtgtgctggagcgaagccttgctcccgttgcattcaatgaagatacactatccaatgtttctctggaaacactacagtctgtacttgattctgacgctccaaaatttatcagcatcggtcgtttttcacctgagaagggacacaaacgacttctggatgcttttgaacaatactggaaggagcaccctgacacctggctgatcatcatcggtggtgttggtaatctctacgatgaaacactggctcataccagggctctgcgcgcatccgatcatattatcctgatccgtgcagtcaccaatcctatgcccattctgaaacgctgtgatctgtttcttctttcttcctattatgaaggacagggaatcgttcttatggaagcggcaacactcggtgtccctgtaatggcctgcgacgtaagtgggtgtcacagttttctgaaaaaatacggcgggcttttgctcgaagattcagaggccggactcctgcacggcatgcagttattcgctgaaggcaaagtattgccactaaatatcgatgccgaacgcatcaaccacacttctgctgctcaggtagaagcactgattgccggtgatatacacatttcaccgcaaaattgaaaggattttctatgacaacaagcaaacctctgatctcagtcatcatgcccgtctataatggcggcagcaccatacgtcaggcagttgaatctgttttctgccagaatattcctctggaactgttggtcattgacgacggttccacggaccagacttcagaagtactgtccgtttatcaggatcgtccggattttcactatctgaaaaatccacataatattggagctgcagcctcccgtaaccggggtgttcaggaagctcatggacagtatgtcgcattccttgatgcagatgactggtgggaaaatggcaaactgctgcttcagctggatactcttcatgaaacaggtcgcgtgctctgttctaccggaagagaactcatgaactacgatggaactcctgccggcaaatatatcccggtgaaggaaacagtctcttacagggatcttctgaaacataacagtatcaactgttcttctgttctcctgttgagagatgtcgctgctgaattcccgatggaacacgatgacagccacgaagactaccttacatggcttaagattttgcgcaaatacggtcccgctgccggtatcgaccgcccgcttcttaaatatcgtatgagcaaaaccagcaaatccggagacaaaaagaaatctgccattatgacttataaagtatatcgttatatgggctacagccacatgcactgtattctgtattttatttcctatgccatacatggattctggaaataccgctgatactgtatcattttaactggaaaggacatagcaaccatgggaaaagccaaaaatctgctgttcacagcatgcctggagcattttggacagattcgtccagattctcatatctggctgttttcttctacagataacagtcattacaattataattcccgttatctttttgaatacgtaaaagaaaatcttccggagatcacccctcttttcgtgatcaatgattcggagcttcgaaatagtctttcctctaaatatggaaaacagtattttatcgaaacagaaagtatacagggtattcgtcaggcactttcagccggtgtatggtttacatctgccgggcttcctgcctatggaatcggtcttcacaaaaagagactgatcattaatctctggcatggtgttccactgaaaaaaattgctcttctggatcctaatctcaaaaaagcagcacgtatttatttcaaaaagattttctctgaaaactatacctgtatcctgacaacctctcatgaactgattccccttatggccagaagttttgctgtttctgaagacaaaatcaaggtctggggacagcctcgaaacgatggactgttccaaaaaaatgactgccgtgaaattttaggccagctgtttccggatcttcctgaatatacaaaaactgtgctttacgctccaacattccgggattatggccaggttcagctgtttccatttaaagattttgatcaggaacagctggaggcatttcttgaggaaaagaacatgttgctttttatacggactcatgttgccgaacagggttctgctgctccatatcttggaaaaagaattcgttttcttggaaatgaacaggctgaagatgtcaccggtattctgaatatctttgactgcctgatcaccgattattccagtatttacattgattatcttctcactgacaaaccaatgatatttcttccgtacgaccgtcagcagtaccttgacggacgcggcatgaattttgattatgatgacgtaacccctggtccgaagcccgagacattcaatgactttctggatgccctctctccaaaagaggatttctggaaatctgaacggacacgggtaaaccgtctttttaatgaaattcagcatccctgtgctgctgatatctgtaacaaggttctgaaaatgattcggtaactttaatctttactgcaccaatactaaggagaatcatatgaaattactgatcgtagatgatgaagagcttacccgcactggtgtgatcacttcgctggactgggcttctcttggcatagatgaagtactgcaggcagatgatggcgtgcacggtcttgaaacagcacggctctgcaagccggaaatcattttgtgtgatgtgcgtatgccccgcatggatggtatttccatgctggaacgtctggaaaagtttcttcctgatactgttccgatcttcatgagcggatactcggacaaagaatatctgaaggcggctatcaaattaaaagcagtcaactatattgaaaagcctttttctatttcagaaatcgaaactgccatccgcgaagcccgtgaactttacacccaaaaagtccattcccgcagaggcgagacactgcattcaatggaaactgcttcccgtctggcactgcagctgactcttccttacggaagcaacagccagatcatagagcagctctcatctgaacttggacttactatgaatgcatccacttattttacttcttttatcgtaaaaacagatctgtttctggatgcatccattccatccatgactgatttttatcaggaattccaggattttctggaatcatttcatatgaaatgcatttatctcgaaaagaaaatgcagtatcttgtttattttctgttttcacagaacgagccaatcaacagacatctgcaatctgtgaacacttacctttgcagtcattttgcagaaatcggacgctattccatggcatgtggtgatacagtattcggcctttcaaaagcttatcagacctatacttctgctgttattctgttacagagcagttacttttttccagaaaataccctgctgacttctgtccagccagacgatagtccggatgtacagagtaatattttttcagactcgccggcggcggcttttgcagatgcattatccaggctggatcagatctccgctgaaactattctccagaaactgtatactactttttataaaaatcatcgttttctgcagaatccggtcaaagatctttattacaaactttttttatgcctggaagatgcccgccaccaacagaagattgccggttccggaaatgttgaaagtatcgccgaaacaattgataactgtttcacatttccggagcttcatcagaccctgatcaccaaaacaaaagaatatttcacgaaagccgaaacaacttctcaggaaaatccaactatttttctgatcaaagactacatcagtaagaattatatgaacgaaactctttctgtaaaggatatcagttcccatgtgtttctttctacttcgtatgtatgcacattctttaaaagcgagaccgggcagacgctgaatcagtatataacagaatatcgtatggaaaaagccaaacagcttctgaaagatgcacgttttaaaatcacagacatatcttccagggttggctacagtgacggtaactattttggaaagagcttcaaaaaatacagtgggctttctccttctgaatacagggagcgaaatttacaatgagtcatattttcacacggatcaggcattcttatggtgatatgaagctggaatccaaattcacattagttctgttgctcacggcaaccgttcctgtcattatgatggcatgctttttctacggaaagctgtacgatatggttgtctcctacacgattcgtcaggaacaggatacttccgcccagacagctccttacatagaagatcttgtacagcagatcattgatgcccatgacggaatcactgatcaggaattttttcagattctgttccaccagcctgttaactcaccatttcagatgtttctggatacaaacgatgcacagtattttcatgaatatgtagaaaatctgattgattctgatatgatctccggtttacagatctatatggattttccaccgcaatctgtacgacttttcagtgatgatcttacgaaagattatttttcacctatgagcaaagctcgtggtacctactggtacggtatctttcagggtacacagcagtcctccctgttctgtcctgctttctatcttggtgaacgcgagaaaaaaaaatacggcgatcttgcatatattacttccacgaccttttattatcagggaaaagcccgtcaggcttacatcgccctttacagttcttcagattatctctcagatatgttgaaagataatctgacgattgacggaagtgtttcttacatcatcaatgatcgaaatgccgtggtcgcatcctccgatgtatccctttcgggtatctatctgttggattacgatacaattgaggaatcttttatgtcctccaacaacttcattgaacggaatattttggatactaccgtgtatgccggcttctataacatcaaacagcccgaatggtttatggttactgtcctgccttctggtccactgattcatcagagtaatgccatcatggttcagtatatcctgatgtatcttggttttctggtattcgccctggttcttgcacattttatgtcacactcgatcacgaaccgaatctcctctgtcatacatcagatgagtaaggtacgtaaaggaaccttaagtcctatggacagtccggaataccatgatgagatcggtgatcttattgatacttacaactatatgacgcgtaagatggatcagcttatgactgatcaggctaaagctgcagaagaacttcgaatcgctgaatttcgttctcttcaggcccagatcaatccacattttctttataataccatggatatgatcaactggctggcgcagcagggacggacagatgaagtttcccgcgccgttcagagtctctcccgcttttataagctgactttaagccgcaaacagagcatcagcacgatttacagagaagcagaacacgtttccatctacctgcagatacagaatatgcgttatcatgacagcattacctttgtatccgacattcctgatgaactcatggaatatcagattccaaagctgactctgcagccaatcattgagaattctgtactgcacggcattctggaaaccgctgataaaacaggaactattgttcttaccggatggatggaagattcagacattgttcttctgatatctgatgacggaatcggaattgctgcggagcaacttgcaacgatcctgtccggtgaaggtgcaagttcctccggtggcacaaatatagcagtgtacaatacacatcgacgtcttcagatcctgtatggccctgattatggactcagctacaccagcaatcccggccatggaacagaagttgaaattcgtatacctgcccgaaagcattctgcaacccttgattctattcctccattatacagaaaataaaaaaagagaccgctttatgcgatctctttttttgaatatgaatatgtgtataaagtagatggtaaaattatcttgtaacgatatcaaccggaatattgaagatttttgctaccttcaggattgtatcgatatgtcttcctgtagctgctgccatatgatgtgtcgggccagcttcgctccagcggttaacaaactctcttgctccacatgtaaagcgtgttctcatgtttgtatcaccgaaagaaaggataggtccttcttcgtttacaccttctgctacaacaaatttgaagtgtccgtctttatcctgtgtgattgcaagataggtaaccggacctgtgtatggatagaactgtgtcaggtatccgccgcctgttttaccgtggaataccggcacgatcttcatggtaggcttcttatcggaaatatcagcatctccacttccggaatgtccaatgatgcagatgtcatcgttgaagtcgatggagtacatttcagaaagctggcctgtaccggaaattgtcttaaggatactcattgccatagcgactttcatatcaccttcaactgcacatgctgtaccctgtttgatcagcatagagaatgccgggatcagcatactgtcaaggacaccagctttaccctgagcaaatccgtcgtaatgagaagcaaccatgctgaggtgctcatcttttacccatttttcaaatgctacaacgtattttgccatatcccatactttttcgattgtgccgccatcttcgatatcgaatgtatcaagaatatcctgagcttttgcgcggattgcttcttcatctgtgatatcatcagcgatagcccacattttttcccagtcaaactgttttgtgtacaggaacattctgttgtacaggtttgtctcatcgatgtaaaggtccatcatacccggatatggtcttccgatctgagctatgttagtatcacggaatcttcttctgacctgagcagctttacaccagtcttcgatctcagcctgtacagccggatctccaccttctacgacacctgtgataacagcatgtctcttgcctgctctttcaaggtcagcaacagcttcaccaacagcaccgcaggcatatccttcaccaagccatgcagcgatatctgtgtgatcgtaatccagtgctttcagtttctgaacgttaaccagaacaactggcacatccagatcacggattgcaggaagcatattgtaagatgtagcataagtcagcatctgaaggaaaacgatgtctacatcagctgcacggaatttatctccagctaccatagactgttcttttgttgttaccattcctccgtcaatgatctctactgtatcaggaattgtcttcttgaatgcctcatactgagcttcaaactcaggtaccagtgatgggaactgaggaagatatgctcctaatgcgatagaaaatacaccaacttttgcctttgtgtttactaacatagtaaaacctcctatttgttatttataaattttgatcccgaaggactcgtggatcgttgtacgagcctcttctacggatttgaaatctccggctttcagcatctgtgctgtaatattaccaattgctgttgcttcgccagggccagcatgaacttcttttcctgtagcttttgctgtcagttcattaaggtatccagcgttagagcctccgccaactacatgaatacggctgtaagttcttcctgtgatctcttccagttcttttgctgtttttgcatagcattcagcaagactggtgtagataactgttgcgatctcgcccattgtttccggaactttctgtcctgttctacggcagtagtcttttacttcttctgtcatattttctggagaaaggaaacattcatcatttgcatttactctggacgggaagtcttttgcttcttctgccattgcgcagatttctgcaaagctgtatttgtcatttacttcatgacgtacagactggatcatccacagacccatgatgtttttgatgtaacggaaacgtccttcgtatccaccttcgtttgtgaagttcagttcacagctctttgcggagcagtccggagtttttctttcgatacccatcagtgaccatgttccggagctgatgtagatgaagtcatcatcgtttgccggtactgcaagaacagcggatcctgtatcatgagttgcaggtgcaactacttccaggtcaaatccaacttctttctgaagttcttctgtcagatgtccaactactgttccaggcatgatcagtttctggaaaattcttcttggatatccaagtttgtcaatgatctcataatcccagtcttttgtttcagcgttaaccatctgtcctgttgtagcttctgtatattcacaagtcttctgtcctgtcagaaggaaatggaaataatccggtacatgaagcagagtttctgctttttccagatattcaggatgttttgtcttaactgccataagctgataaatagtattgtaaatagctttctggataccagttcttgcatacagttcttctactggaatgaatttgtaaacttcttcatccatgccttctgtacggtgatcacgatatcctacagtgtttccaagtactttgtcttctttgtcaagaagaacgaagtcaacgccccaggtatcaacacccatacttaccggaatcttgccgatttctttacattttttaagaccagcaacgatttctgtaaaaattcggtcgaattcccaacagagttctccgtctttcttaaccataccattttcgaaacgatggatttcttcaagttccatctttccgttttccatgtgtccaagaatcagacgtccactggatgcgcccatatctactgctgcataatatgttgccattgttaaatcctcctaaatatgtaagatgtgtatagcatttattgttgtgcaaaatgctatgtcaaaaaggttctttcatatttgataataacataatatcctaaaaagcgataaatgttaagaacctcgtttgtaaaaaaaagtgtcctcagttgctttattgaagtaaattgtgaatgtgttacttaaaaaacccccagggcaaatgccctgggggttttcaccctaaactaaagattagtcataaaggtttggagcgatttcttcatcgtccatgtttgtagaatcataccagtaaccatctgtaggaacatcttcaagctcctgtccgttagctgctgctgtcagagcgtaaattgcatagtagcccatcatcagaggagactgtgtaactgcaccaaggaatgttccgtcctgaactgctgctttgatgatagaaccagcgtcgaaaccaacaccgataacatcgcctgctgctgcgtcagatccaagaacgttcaggttagcgttagctgcaagaacaccttctgctgctgtctggttggaaccgaagatagcgatgcagttttctttggaaaggatagcctgagcttcgttagagcaaagctctacagttgtctgtgccggtacagcaacctggataacaacgtctgcgtcagcttctgttgcatcagcgtttttagctgcgtttacatagaattcgtttccagcaactgctactgtttttccgtcagcctgaagcagttcgatcattttgtcgatgaatccgccaccacgctgctggatgttctgagctgtagcatcctggttaacttcaccgatgacaacctgtccttctgcgttagctacaacatctttgattgcgttgtacatattttcagctgctacagaaccagcctgagcgttgtctgtacaaacttcgcaagcgatagatccttctggagcatctgcgatacctgtatcgaatgtaacaaccgggattcctttagatacacaatcgttcagagcgtcaagaacggaagatgtatcacaagctgcaagtcctaatcctttcgggttggaagcgattgctgtgttgatcatgttaacctggtcagcgatatcagattcactgttcggtccctgtgctgtgtaagtaacaccaagttcttcagcagctttcttcataccttcctgtgctgcatcccagtatgtggactggaaagatttaaccatcatcgggaactcataagcttcatttgctttgagatctttgaactgatccggaagatcagctgccataactgttgatgcggacattcctgctaccattgctgcacagatgcttaatgctactacctttttgaaattcataatttacttcctccttataaatataaattatatagtttttatgatgatacgtcagtaggaaattgtctgacgccccacatccttatgaagttttaataaatattcaatttcttttacagcagagcggatatctataatccactgtgctgtttaaatcattcatttatactgcttacatagcagcttttttcttttctttgatgatatcaatcaggactgctacgataagtacaagacctgtgatgatctgctgccagttagcctgcaggccgatatatggaagacctgtcttcaggagcatgataacgaagataccaacaaatgttccgattacggaaccgtaaccaccggttgccgcaacaccaccaacgaatacaccgccgatagcatccatttcaagtccggcacctgtaccaggctgtacggtaggtgttactgctgcataagcgattgctgcaagtcctacgaacagaccacatactacgtataccataacgtggtagaattttacattgattccagaaagagctgctgcttctttgttagatccgattgcgatagtgtaacgtccgaattttgtgtgattcagaacgaattccatcagcagaaccagaagaaccatccacaggaacccgatcggataacgggaagcacttcttcctgtaccaactgtgatcttgaagattgagtggaaccatccaccatcctgtgtaagtcccggccatggtgttgcgctgcagagagaaccagcaccacgggtgatcatacatgtacaaagagttgcaaggaacggcggcaggttcataacaccgatgagcacaccattcagggctccaatgacgagtccaagtaccaggcagagcaccatagctgctgctaccggccatccatggcttcttaccattgttccggcgataagtgcataacaaaccataccggttccgattgacaggtctacaccaccagtgataagtgggaatgtaacaccgattgccatcagaagatcatagtaagagaaatccaacatacttaagagagttgtatactgtctgaactccttactcataatggagaagatcgctgtcagagcgatgataaccagtaatacaataaatctctgatcacttataatactttttttcttcttagtcatgactatcctccttaatcgatatttcttgtggccttatccatgatgcgttcctgtgtagcttcggaaatatcaatatttccagttactttaccttcgcacataacgatgatacggtcactcaaacggagaatttctgtcatttcagaagaaatcatgatgattgattttccttctgctgccagtttactcattaacttgtaaatttcgttcttggcaccaacgtcgatacctcttgtaggttcgtcgaaaatcagaatgtcactgtcgcgggtaagccatttagcaataacaactttctgctggttaccaccggaaaggttaactaccagctgatcaccgcttggtgtcttagttgccagttctttaacatatctttcgctgacttctttttcttttgccttattgatgaagattccatttgtgaactcttccattgttgccagtgttgtgttttcgttaacagatttctgaactacaacaccatatcttcttctgtcctctgacagataaccgataccatatttaacagcatcctgcgggctgttgattgtaacttctctgagctgtccgctcttgtccataatggaaatctttccactctgtttcgggtctgctccgaaaagtgctcttgcagtctctgtacgtcctgcacccataagtcccgagaaaccaagaatttcacctttgcgaagttcaaagcttacgtcctgaaccatcttaccagcgttcagatgttctactttaagaacaaccggtgcatctggtgcaaccatgctgtgttccttcggatcttcataaataacacgaccaaccatcatgttaatgatgtcttcttttgtactgtcttttgtgatcagagttcctacatatccaccatctcgcatgactgttacacggtctgtgataactttgatctcatccatacgatgtgagatatatacgataccgagattcttctcacgaagatcacgaatgattacaaacaggtcagcgatttctttttctgtaagagctgctgacggctcatcgaagatgataacttctgctttgtgggaaatagcttttgcgatctcacacatctgctgtttaccaacagtaaggttgctcatcttttctcttgggtcgatttcaatgttcagatccttgaataacttcttggaatcttcaaccatcttcttatcatctacacggataccttttttcggctcacgtccgataaagatgttctgtgcaactgtaaggtcaccgaccatgtttaattcctgatgtacgattacgataccattgtcctgtgcttcacgagtattgtgaaaagcaacttcctggcctttgtatgtaatagatccggaatctttctgataaataccggtaagaactttcataagtgttgatttaccggcaccgttctctcccataagtgcatgtacttcaccgcgtctcacttcgaagttaacgtgatccagggcatgaactccaggaaaggacttatcaatatccttcattgttaaaataacgtcacccattgtttcatcctccctttcgatcagttctttctacgtcttgcagaaacgtcggcatatacagctacgattacgatgatacctgtgatgatcatctgctgtcctttaccaagaccaaatgccatgataccctgctgcagaagagagataataaatacaccgattacagtaccaccgatggaagcaagtccaccaaccatggatgtaccacccattacacaaccagcgattgcttcgttgttgtactgatcgccataacctggctgaacggttgtatatgttgctacaaagaacagtgctgcgattccaacaaggaatccacagattacatatgcaagcatgttccatttcttggtatctacaccagaaagtctaactgcttcgctgttggatccaaggcaaaggatgtaacgtcctggttttgtattgtaaagaacgataccacatacaactgccattccgaggaagattaccagacctaccgggaatccgttaactgatacgatgctacggaaccatccgtttttcggatcactgctcagcggccagcttacagactgtgtttttgtaaatacagaagcgataccttttgcgatattcatggatgccatggatacgataaatgccggaactgacagataagataccagccatccgttgaagataccgaatgcaaggccgatcagaatgcagataaccattgctgctgcacatggaacaccataagatgtcatgcagtaaccggataccagtgcacaacagaacataaccggtccgatggagaaatcgattcctccggttgcgattacgaacgtaacaccaagtgacaggaagcccaagaagtatacatagttcaatgtggacttaatgctgtctccaacagggaatttatttcccagcactaccttaaaaactgcgaacatcactatcagaatacatacaagtaagattctgttcagtccgagctttttgactattggattttgtttcagcttttccaatgtttcaccctccttaaaagttttacacacaactcttgcgttttctatataataccgttaaacccgcacaaatgtaatggaatatcttccaaaaaaaggttaaatatttacggttcgtacataaatatttaaccttttttagagttttttcactattatattctttttttgacctttctgttcacaaaatcatcaggaaagtttgagcgtattgaacggaaacagcaatttctcgatctcactgttgtacatattttcgggagtcaccagttcacagccggaatttacatttttttcgtagctcttgccgcgaagcataaggacggtttccttcacacccatatatcccatcttaaatgctttctgaacaacaagcgctttaaatacaccattttccatcagctgaacagcttcctgtgaactgtcgacaccaactacctgaatccggtctttcgctccagctgccttaactgcccttgcagcacctactgatgaatattcgttcattcctgcgatcatcttaagattcggatatttttgcataagttcatttgtcagtttacgtgatttctcatactgcgaatcacaatatacgacctcaacaatattatctgccagatctccgagtcctttgcgaaatccctcttctctctccactgcggtggatacacccttcacatgggccacgatcgcaatctgatcatccggtccgagaagtgatgccgcaaatttaccgagtttctctcctgcttccagattgtccgttgcaaccgtcagatcctgcaccgcttcttccgtataggaatcaataaaactgatcctaattcctttttcctttgcttcatccaatattttgttggattctgtaaaactggatggagagatcagaatcgcatccggtccctcttcaatcgcctctttcagtagttcattctgtcgttccacatcattttcttctgtcggtgccttgatctcgattgctgcattgtactcctgtgctgccattctggttcccaggatcagtgctttccagaaatcatttgtcttgtctacgacctttggaatatacacaagcgaaagcctgcgctcatcaattcttttctggcgataccagatgccacctccgattccgccgatcagacagactaccagaaagatactcagccattttttctttttcatatctgtccctcctgtctgcctggaattgtgatcgttgcagttgttcctttacccaattcactggtatacgtaattccgtaatcttctccataatagagttttaaacgtttctgcacattatagacacctactccgttggaatgataattcactttatgtttatcataaatatgagcaagagtttcttcatccattccaactccatcgtcaatcacctgaaggactgcatttccatccttcataaatccttttacaataagaaggcccttactttctttatatttaagtccatggtagattgcattctctatgattggctgaagtacaagcttgatcagagggatatataatatagaagaatctacctcaatctgaaattccagtttatctttgtaacgcattttctgtatcgtcagatagccgcgcgcatactctacttcgttcgcgatcggaacaacttcatcctcattgctgatactctggcggagaagtcttgcaagagatgccgtcataagaacaacttcttcatttttctttccttctgccatccagatgatcgaatccagcgtattataaaggaaatgcggattgatctgggattgcaatgccttcagctcgctcttacgtttttcttcctgttcgtggacattctgctccatcagttcatggatccggtgtgtcatcacgtcaaaggactttgtcagactgccgatttcattttttgaatctaccacaacatcagaaacactgaaatcaccttcctgtacttttttcatggaatcacggagtttctgtatcggaagagtaatactccttgccatgaatcttgaaaaaagaagtgccacaatgaccagtatgattgccgtcagtacatagacactctgtgcctgacgactttttctcaaaagttctcttacactggtgcagtctacgacagtccatcccgtctttcctgaacgtgagatggaatacagttttccatcgtttccggtaccggtcagtacggtatcttcatccgtatccatgatcagactgatattttcggtctgcagttcattgtagagctgttgctgctgtggatgataaacaatattgccctttgcatccagaataaatgcatagccttttgttccaaccgtactctgatcgcagagttcactgatcgcgctgtaattcaggtcaataaaaaagacgccttctttttcaccacttccgcttcgatcacgaatgccacgactcagagtgatcacccatgggcgttctccactaatgatgtgctgtacatgggaagaagtcaggatcggaccattaggcttttcgagtgcagtagcataccattcctgcgtattgagatccagatcctgattcaccgatttacttccgtcattgatcagcatccgtccgttcttactgatgataccaacatttcgaatatcactccggctgtccaggattgtctggagctgatttaaaatacggtatcttccctcgttatcgattttctcatcaaaaaggtaatcctgcacatcttcattgctggatatcagataagcaatattttccatataatcgatataagaatcgatattctgattcatctgctggatgatcgtatgcgtatattccgatgaattttcaaaaatagatgtattggtaaatttcatggaaacaccggtaacgatcacaaccgcactcagaatcaggactgcaacggttgcaaaaataacgctctgtatactgctgaattttccaataaatctcgccgacagatttttctttttcatctgcgcttctccctagcatattccgtaggtgtacacccggtcatttttttaaatgagattccgaaataatgtggatcagaaaatccgactttttctgcaatctcataattctttaaggttgtattttccagcagttcttttgctttttccattctggtccgaatcaggacttcggtaaatgtctcacctgtctcgtctttaaaaatcgtactgaaatagctggtgctgatattcagataagaacagatactgttcagactcagatccggatccatataatttttctgtatgtagtcaatcgcaagtcgggcctgccgctcgctactggatgtattcagttcagaaaggatctcaaaaatcctgtccgtatgtttctgtacaactttacaggcatcttcaaaaaatttctgatctgttacctggcggagcagttcatctctgtcttctctgatcctgtccatatcagcagatacatcttcgcatgcattgtccattgtacggatgacctgctgcagatacatgcaggcacggcttttttccataagtgcctgacgaatggaattttcaatctttatgagggtctggtaaaccagctctttctgtccggtcttcattgcttctttgagttctgccagatcatcttcgatcgcgatttcctgaacggggtgctgttcttccatatcaataagaatgtttccaccaagaagatagcgatactgaagggtctgtgcagccatatcgtgtgactggatcagttcttctggtttttttacccatttaccgatacccatggatacgtcaaatcccatgacttcttttgttttttcctgaatttcatgacagatttcttttgttctggatgtaaaattacggctccatttttcctgaaaaaggattccgacgcggttattaccttcctggtaggcaataccggcctcttctctggtgacgatctcatcgctgatattgaaaaggacaaatgccatcagtgcgctttcctgacgtttttctgtatccagctggtacataccagaatagaggtcgatatcaaagattgccacgcggtaacttgctgcggagatgtcaattcccatttccgcaagacgttcaatacttgcattcacatctgtcgtacagtttacaagtgcttctatattttttgaccggattatctgcttatttttacgatactcttccgagttttgggtcagtgcatccattttacttttttcaagacgttgctgttccacttttttcttcattttttcaattaccccggtaagttccatcgctgtcaccggtttcaacagatattcacttactccatactgaattgccttttttgcatattcaaattctccgaatccgctaaaaatcacaattacaatttccggataattatcatgcagaaaattgctcagttccattccgtccatgtatggcatcaatatatctgtcaacacaatatccaccggatgttcttttacaaattctgctgcctctttgccgttttcacaatctccgaccagttcacagtccatgcttttccagtcaatattctctttgatcgcatcacgaacaagaatttcatcatctaccagcaaaatacgatacatgtattctttcccccatcttatcttcacagtaatctctgggtactgtgatatatggctctttaactttgcctttaataatttattttaacatgatttttgttctttttgaagtacagaatttaaaaagaccctgccggtcagcctgatgcttcctggcaggatcctgtcatttcttttatttctttttatttgccggcaaataccttcattgcctcataagcatttttcttcatggctttcattccccagtctacaatgtcatgatagtaaaccggaatctctttgccttcttcctgaagtaaataatgcatcttatatttcttgccctggtgaacgatcggcatctcctggaatggaagtttgctttctacaccagttccaccggcttttgccatatatgtatagtagttgatctttcttactccacgggcgattactttcttgtaatcttcttcgctgacaccagaaccaccatgcataacaagtgggatatctactcttgcttttacagcttcaagtacagacatatccagtttcggctgtgtcagataaaggccatgtgcagttccgaaagagcatgccagtgcgtcaatacctgtttcattaacaaaagattctgccagcttcggatctgtatagatttttttcggttcatcacctgttgggattccgtcatcatgtccaaggcccagttctctcttaccaagagttccaatctcagcctctacagaagccccctttgcatgtgcaagtttcactgcgatcttggtgttggctacgttctcttcatatggaagtgcagagccatcgaacataacagacgtaaatccaatattcagtgctttgtcaagataagcaagtgtttcaccatgatccagatgaacacataccggcactttggcaacctttgctctttcaatcatgatcggtccgatcacgctgattggcatcattggttcatgtacttctgcatgcattatgattaccggcacatttaattcttctgctgcttcgataacagccatgatgctctcaaggtttggtgtattaaaggatcctactgcgcacttctttgcttcggcgagctgcagaacctcagataatgttacaagcattttcaagcttcctttctagccttcctttggctacaacaaatatgttaagagtataacacaatatcaaaatattgtgaagtattctgacatcttattttttcaaaataagtgcgataaaagtaagatctccctttccggaattcagaagtccatgaccttctccgtcatcacagaaaaccacatcacctgctttaaccggatatttagttccattgtcattataagttccactgcctgcaagaataaagtaagtctctgattcaccttcatgtacatgaaaagcaagatcactgccttctggcatggttacttctgtatacattctgcagtgttctcccagttctttaccataaagaagcgcatttttcttcagaataccggatccctcaccggtcagttcttcaatttctatctctggtctttcaatctttgccataataattatctcctgtctcttctcagatcaagccattccgcttcatcctttgtcaatgtaatatccagtgcctgtacattgcttacaattctgctcgctttctttgcactgacaagtggaaatacttcaaaatcctggttcatgatccatgcaagtgcgatctgcggcactgaacagttcttttctgcagccagctgctctgctcttgcaaggcgttcaaagttctccgggtagcaatagccttttactgcaaatggatcaaggatcttctttgccccttctatatcattgctcttgacgattccagcaaacatgcctcttccaagacttgaataagcaagtaccggaatatgattgtcacgataccatgctcttgcttcttcatttgccggaccggaaattgttacacatcctggcccgccaccccacggatcatcaatctgattgcagagtccgaagttcggactggacacagtaaaaggaacgagtccatatttcgaggcatatgcattcgcttctgcgattctctgatgggtccagttggaaccaccaaaagccccgatccgtccggccttgtgatattcgttcaggatttctaccattggccccggatcaaccattggattgtctctgtgcatcagataaatatctatgtaatccgttcccaggcgttcaaaagactgctcaatatcgtgtttcagatcttccggtgttacgcggtctctcccatcgtaaggatgacatcctttggaaatgatcacaactttttctctgtttcctctgtttttgagccaatgtcccagagaagcctcactcaatccataattttcagctgtatcaaaagtcgtaattccctgcgcataaacctcatccagcagttcatctgcatcttctccctgaatcatcaccggtattgcgcagccaaaaatgatcttcgataatggtttttcaacattttttattttctgatatttcacttcagatttcctgccttttgttcttatttctgatacagtttaatatccacatgatagtcaactgcttctcctggcttcaggaatttcagcattccggtttttctcatgacatctcttccgtccggataacagttgccgcattccagaccaagcacataatcacgaacccccatcatcttccattccacaaatccatccagtttagaagcgtcaaaactgatttccagtccaacatttaatttgggctgatagatgcctgctttgccatcagcaccttcgaatttgtgataatagcatctttcctgataatcaccctgcggtttttccatatgcatccagttggcaatgtcttcctgagcatgatcatcacgtgccctgacttccaccgatggaatcgttacttcgctgtcttcatccagaagcggatagcccatgttcatatgatacaggatctccattggctctgtcttgcttcctgtattttcaatatgatcatcaatagaaaatgtattttcttctttggaaatcgttactgttcttttgagaacaagctttctgccaaagatcacttcatcttttgttacagaatgaatacgaatttctttgtcatcctcttcccagtaactctgtgcacatggctggtttgcgatcgaaccatgaagtggaagttcttctccatcatctatacacggtgtgccaacagcctgcagaccacaggttgtcagaaatcctgctgtaaatgactgaagccagttagctcctaccttgtcataatatgccggagccacataaccacatggagaaaaataactcatgttgatgcctttatagcgaagtcttgtaatatctccgtttctgtccggggaaagtgtcagttccaggccttttccgtttgttgcttcatagagacgcatgccgtcgcctttgcctccgaccagacgatgttcttcaacaccgcttaactgtgtttcatgtccaatatacggattcattgtaatctcctttcagatagttatgctcttatggcagaagccgcccgtttacacgagcggtctcactgcctgatatactttcgcatatctttcaaagatatgcatgtatttttcatgcatttcctttcttggaaggtattccacggtttcttctaccatatgttcagccgcatcattcaagtctttgaatactcctgtggcaatacctgtcagcatagcactgccaactgtacctgcatcaactgttttgagtgctgtaatcggtacattcagcatatctgctttcatctgcatccattctcctgaccttgcaccgccaccggttgcattgagctttttgaatttacatccagatttcttcaatgcgctggtattcaccagcatttcataaacaacaccttccatgcagcctcgataaatatctgctacagtcgtgtctatggtaagtccaagaattgctcctttggatcctgtgtccatataaggtgttgccgctccagcaaaatgaggaagaatcaacagattgcttggattttcttcaccgcgctctgttgcatatttcttttcgagatattcattcactgaaaggtctctgtctgctgctgctcttttttcatcttttgcaagattatccacacaccactggatcagtgccccgccggtataggaaaaagcataagcaacatattttccggggatcacatatggtacaatggaaaaatatccatcgtacattgcctctatatccggaatcgaatcataaattggagttacacattcaacagttcctgcgccgtctactgcaacagaagaatcaaatgcaccggctccaattgccgcagatacctgatcatgactgatcgatacaatatgtgtggacggtgctaggccagttttctctgctgcctctgctgtgatcactccggcatctgtacctgtcggtaccgtctttgacattttattcacatcaatgccggctacttcaaagatttccttactccagtcaagtttcttaatatcaaatgccatagtcctggtagccagggaataatcaatctggcgttttccagtcagatgatatactacataatcttccatcaggaatatgtatgcagctgcatcgtaaatctcaggcttgttttttttgatccacatcattttagaaatactgtacatctgatgtgctcgcagaccggtgattccggcaagttcacgcgcaccaaatttttctgtcaaagctttgcattcttcttctccacgtggatctgtataaagcatggctgtatgaagtggtttaccattttcatctgtcataacaaaagtttctccgaaactggtcacaccgattccggcaatgtccggatattcttttgccatttctgcgactactgcataaaccccatccatgattgtagatacatctacttcatgtccgctgacgtttctgcggaccggataatctttgtatgctttattcagatatcttccctgttcatcaaataccgtacatttacaaccagtcgttcctatatccaatcctgcaattttcatatcattcgctcctagtcaatatctacccattcatatcccagatatgtagtaaatgcttcttttaagatgtctttcatatgtccgacacctacacatgtatgatgtttaaatccacctcttgccagacggatcatcttatcttccatattcggaatctggcatacaccggcgcatccaaagtatgcatcctcgatcggatcatcggtaaattctgcttcagatgcatagattttgatcttaccatctactgtcaggcagttagaaattgttgtcttgaatggacgaattcttccttcgttggttccccagccacttcccggatcgcctttgtcaaacatcttgtgggatgtaacggttcctttctttgtcatcagactctgtgcacaggatccacagtggaaaagaatcagtttatcttctgcatcgccgtagttgttgttccagtcaagtactgctgtcggctgttcgcttgccaactgcattgcacgcatggagattgcagatgtcaggtcaatctcgcaggaagtagcaattccacggtcattcagttcagacaggagtacacacggacatacgcggaggattgtctccatttcattccaacaacggattgcaagtgcatccagatgatattcctcaacatattcatcaataacaacagagatcttggaaagcatgatcttcttgtcttccggtacatttgagaaatctgtgtaattttccaggcgttccttctttgccagtacgaccggatcgttatcctcttttgcatttactttgaagaatacttcagaaaggtcaaatgcttctaccgtaataccatttttctgtaaaccaatctcatcaaaacgtgtagtcttgaatgctgtagttcttgctccgatgcatccgatcgtaaagcgtttcataccgttaacaactcggcagatagcagcaaaatctcttaagttctcctggaatttctcagaaagcggatgaactacatgtggttttaatactgtaaatggaacctgatactgagtaaatacatctgttacagagaatttaccgcagaatgcatcacgtctgtgtgcaaaatccatcttgccgatttcatccggatatgcctgcatcaggatcggaactcctgcatcctgaagtgctgtgatcgcaccattctcatctgcaaagattggcatagagaagataacgccgtcatactgtccttcgtgctctttgagccattttgcatagagaaggccttcgtctcttgtctcgattccgccgtatcttgtcaggtctgcatccattgcgatataatcatatcctgcgtccgttacagctttgatcatatcctctcttgctccgtagatcagctcgcccggcataaatcctcggttacaaaatgccaatgcaaatgtcatctttttgctcatatctatatactccttgtttcttcttgagtgtttttttcattttctgtgtttattttagtggattttctttttcttttatatagacttttgttctacttactttgattttgttcgcatttgtgatatgattcctgtattgtccagactttaggacaatacatttcagctatatagaaaggatgtaactgtacggacacgaaacagttacgcaaggagcttcccaaatgatatccagctttgatattgccaaattgcattctttgttaaaagacttttatcagctcacaaaaatccgcatcactgtttttgatgactcttttcgtgaactgacttcttatccggatgagatcgcagatttctgtaaactgatccgccagacacccggctgtgccatgaaatgtcatctgtgtgaccgccatgcctgtgagattgcttcgcgtcgtacttcttcttatacttatcactgtcatgccgggcttacagagagtatcatcccgatccgtatgggaaacattgtgatcggttatcttctgttcggacatgttttttcgtatacaagttatgacgagggttggaaagtgatccgcgagagatgtgctgattatggaatttcttttgatgagcttgagaaatgctgccggaagcttccaaacctttcggaagaatatattgattccgcttcgcatattatgaaagcggtcgcatcttatctttgtatggaccgtatggtttcgatgcatcagcaggaacttccagtacagattgatgaatatattcagtcacactacactgaaagaatcgacgcggtgtcgattgcacagcattttcacattggaaaaacgaagatttatgaaatcgcccggcagaattatggaatgggcatcgcggaatatatccggaaactgcggattgaccgggcaagacagcttctggcggagcagacggatctgtcacttgctgagattgcctataagtgtggtttcagtgattataattattttatcacggtatttaagaagctggtcggagttccaccgatcgcgtaccggcaacagatcgtgaaggcagagtaaggggagagcggccttcgcaactgcgagcgccctcccctcgcaaagtttttcaattgtcaaaatgattgacgggtctaaggacagttcccttacttaacaataaatccctcttcatcccacagatcatgccaatcctttgcaccttcccacaggaatacctggcctttaaccagacggtttcctctttccagtgttccaatcttggccatttcttcttctgtcaacggatcttctgtcacacacttcagattacttacataattatgtacagagaatggaatagaaatctcacctctctgatgagcccatttcagagcgatcagtgcaggatgaacaccgtgtgctttggcaatttcctgcatttccggtgtctgcatatccgcaacatcttccggacagatatctctttccggtcttctcggtgaaccaagtggcatatagcctaccggctggatattatgagcaacaagataatcatactgttcctgctgctggaagcatggatgaagttccagttcacaggctgccggtttgattttcattaaaggaagaaccgcttccagtttcgggatggtcatattggaaataccaatataacgaatttttcctttttctaccagttcttcacactgacgatatgtatccatgaattcttctacgctgaatggtctggaatctggatttctggaatctacatcacagaatggtgcatgatagttcgggaatggccagtgaatgaaatacagatctacataatcgcactgaagatcctgaatactctttgtgcaggcttcttcaacctttctgtgcatgtcattccatacttttgtcatgataaaaagatcttttctttctacaacaccttcatcaaaagctgttttgaaaacctcacctatctgatgttcatttccgtagcatgctgcacagtcaaacatacgatatccgctgcggattgcacctgcaactgctgcggaaacatcttcagcgcttactctgtcagaaccaaaggttcccatacccatacatggaacttcttctcctgacggaagtgttaccttcggcacgattgccggatcaataaattctgccatttttgtttcctcctaaattgtattatatagtttttgtataacaatctgtggaagcagtttttccatatcttccattacaaaaaatcccgtttcttcacgcattgccgcagcggctgagattgcacttgctcttcttaaagtttcttccagagaaaggccctcgcttaatccaagtgcaaaacctgcgatcatggaatcaccgcatcccactgtatttacggcatcaatctttggaacgattgcacggaagatgccttcttcaccaacagccagagaaccatctgcaccaagggaaactgctacgatctccactccgtttgcatggattgtcttagctgcatcaatgatatcctgaatgtcatcacagtgtttgcctgtcagcatacggatctcatcaatgtttggtttgatcagtgtcggacatgcttcgattcccatttcaagaagtttgccactggtatcaaggatcaccggtttgccagcttcttttacgattttgaccagtctctgatatgcagttccatcaagccccttcggtacacttccggacatggaaacaacatctgcatccttaaccagctctgtaaattttttttcaaatccccggaaatcttcttcagtcaacgtaaatcccggttccagaaattctgtctgtacatgattcacttcatcccatatattgatgcaggatctactttccgcatctacatgataaaactcacctttgattccaaacggtttcagagcatcttcaatatagtttcctgcgtgaccacctacaaatccggttgctacgacttccgcaccataaatagatgccggcttggatacattaagacctttgcctccgggaacgtaagaacattcccggacacgatttacttcacctgctttaaaatcatcaactacatatcgtttatcgattgcagcatttaatgttactgtcagtatcattttattcttcctcgtttgataacaggatcttaccttttacaaatcctggtgtcttaaataactggaatgcttcctgtgcctggctcatcgggattttcttataaatgaagcccggatcaaatttcagctgaccggttgcaaagtaatgtgctgtcagatcccattcacgtcccgggaatggtgcactgtaagacatccatgaacctgtcagtttgaactctttacggttcatattttcccactgttttggtgtaaaggtcagattctcatgcggtgttccgataaagcatacatgagctttgtttgcagccagttcaaatgccatatgcatggtcggaacctgtccggctgtctcaaatacgaaaccatatccttttccgcctgtgatatccatggctttttccatatatccttcttcttttgtattgatgacttcatctgcaccaagacgttttgcaagtgcaagacgttcatcactgatatcgaatacaacaacttttttggaaccgaagatctttgtccactgcatagtgaacattccgactgtaccaccaccaaggattgcaacatattcgccaccatgataatcattctggaatacaccgtggattgctactgttgcaggttcaaacatagcgccttgttcatatggaactgtcttgtcaaagggtactgcattctgctccggaactactacatagtcagcgttgcttccctgctgtctggaaccaataaagctgtaatgtttgcaaagagagaagttacccttctgacagtcatcacatttcatgcatggaagaagcggtgcgcctgatacacggtcaccaactttgacctttgttacgccttcgccaacttctaccacatcaccggaaaattcatgtcccagaacaattggataaaaatgaactccgtgattgagaacacgaggaatgtcagaaccacagataccagagtatctgactttgatttttacagttcctttggttacttttggttcttcgacttcctgatactgtacatcttcatttgcaactactactgctgctttcataatatatacctctcctttaataacatgtttttatttcgcggtcatcatatgggccagggacttatagagttcaagataagtctgataagtcttatcataaactgctttgttctccggacttggttcatgacggcgggtttctttgacagtaagtgaaactgcctcatcataatccttatagaatccaactcctacgcctgcaaggattgctgctccaagtgtcgtagccgtatcagatgccggaacaacgatcggtttacctgtgatatcggatttaatctgtgtccagagtaaagaattcgcagatccacccatggctctcagaacttctgcctccgctccggcttcctctgcaacttccagattatgtctcagggaaagagccactccttccatacaggcacgcaccatatgtcccttggtcttggcaaaatccaggccgtagaaaacaccttttgcatacggattccagattggtgagcgctctccggacatatatggaagaaataccattccatcacatcccggggctactttttctgcgatttcattaagctgatccagtgatgaagctcctgtctgttctttcatcatacgctcatagtctgcaaattcatgttcaaaccagcgcatgactccaccgcctccggtagttcctccctgaaggagccacttgcccggaacaacatgataactgaggatcaaccttggatcagctttgtactcatctgtacaaatgctcattcctccggcctgtcctccctgttcctgtgtttctcctgtatggatcacaccagctccaagcgttccgcatgcagcatcaagtccaccggcaacaaccggtgttccctcggcaagtccacactctgctgctgccttcgcggtgacagtgcctaccacatgatcacagtcacatatttccggaaggaatcccatcggaattccaagctgttcacacatctcttcatcccagcatccttttttcatatcaaagcaatgcagtccatatccctgagaaacatcctgcgtgatcgcatctgtcagtttaaatgcaatgtagctgttcgactgaaggatcttgtatatttttttataaacctccggctgattttccctgtaccagatgatctttgctgtagaataagatggctgaagggaatttcctgatatcttaaaaatcttatcagccccaatctcctgattcagtctgtcacaaatagactgtgctctggtgtccatccagatcggagtattggtaaggacttttccttcctgatctattgcaattgccgaccagctctgtccgtcaattcccactccggcgatttcttccggtgcgattccggctttctgtatcgtttcctccgttgcctggcagactacgctccaccattcttcaggattctgctccgcccatccctcatgcggataatataccggataagcaccatttgcagccgcaaggactctgccttctctgtcaaatacagcaaccttacaggcacttgttccgatgtcaattccaattaaatatgattttttcattttgctgctcccattttccgaaatatccggattttcttctcttcagctgacactccaatctgttctctctgtatcattttaaagtatttacagacttgccttctatgatttctgtctgcagcttttctgtaaaaaactcttctgattcttttttgccattttccagatgttccagcatgattcttgccacttctctggcaattccatccgttggctgtgatacgatcgtcagctttgggttacatgctctcgcaaactgcagattgtcaaaaccaatcacagaaagctgttccggtatctgtattccaagttcatttactccgatcatggcccccattgtcatttcgtagttggtcacaaacaccgctgtcatatccggatttttctgcaccagttcctccagactccgtacaccgccctgaatcgtataatctccatgacagatcagggattctctgaccggaattccggccttttccaatgctctgtaatatccggccatacgttcctgtgcagtaaaaatccccttcggtccaccgatgataccgatatagcgatggcctctttctataaactgtcgtactgcatcctccgcagcttttttattgtccaccaacacactgtcacaggagattccctgtatcttacggtcaatcagaacgattggttttcctgtcttctgaaatttcttcagatgatttccttcttcatcaaccggcatattaataaccccgtcaacccgcctgcggatcaggaactctattgcctcccgttccagtttcttatcggttcgacagtcacagacgatcgtggcatagccatgacttcgaaggacatcttccatacccgttatgatttcagcgcagaatgtattattcagctccggaatcaccacacctatcgttttggtcgcattcgtcttcagccctctggcaacttcattgacttcataatggagttcctcaatggcttcttcaatctttattctgtttttctctcggacattaccgccattaaaatacgaagaaatcgtagccagaccaagaccagtccgtctggcgatgtctttcattgttgccgccattatatctcactgccttcttttccaatgatatttccgtgtgctgaatcatggttctcgtacttttgtttttattctgcttttccgtcacatccgcagactttcattcttgccataaccagttccttcaccgctgcaatagctgtcttgccatatgctttcggatcaatggtatccggtttttctgcaagaagttctttcactgccttagaatatgctgcacgaagttctgtagcaaagtttactttgcagataccacgttttacacaatccataacatcttcatcgctgagtccggatgcgccatggagaaccagcggaatgtctacgacttcacgaatctcactgagacgttctttgtcgagaaccggtgttcccacatagaaaccatgtgcagttccgattgcaactgcaagagatgtaactcctgtacgctctacgaattcttttgcttcctgtggatctgtgttggtgtctgcctctgcttccagatcatcttctttgccgccgaccttaccaagttctgcttcacatggaatatcaagtgcttttgctacatctgccacacgtttggtctctgcgatgtttgcttcaaaatccagtttggatccatcgatcataacagaagtatatcctgcatgtattgcctgcatagcaagctcaaagctgctgccatgatccagatgaaggcataccggaacagatgctttctttgcttctgctgcaacgattgccgcataggtatctacggtaccgtatttaactgtagatggtgtagtctgaatcataactggtgctttgagttcttctgctgcctgaatgattgctttgaccatctccatgttctctgcgttaaatgcacctactgcataaccgcctttctgagctttggacagcatttcttttgatgtaacaagtggcataatgattttcctcctcataatatatgtatgatttttgttcttactgtttctgtaatgccggataacatttgcaaaaccgaaacgtttccgtttgagccaatcatacctctgttctctgcttctgtcaaccataaaatattcacttttcactttcttcaaaacagtgtaaaatattcatcttttatcggaaaatattctcttgcaaagtatcataaatgcaggtacattctttatatagaggctgtctctgtgcgagatatgccataattcagtaaaaatttgaacggaggcataaagatatgttaaaaggaattcctgaaatcttatcacctgaattattaaaggtattatgtgaaatgggacacagcgatcgtcttgttatcgcagacggtaacttcccggttgaatctatgggtaaaaatgcgattaccatccgctgtgacggacatggtgttccggaaattctggaagcgatcctgaaagttttcccactggatacttatgtagaacatccggttaacctgatggaagtaatgcctggtgacgatgtagaaaccccaatctgggatacctacaaagagatcatccgtaaatatgatgacagaggagatgctgtagtaggaaacatcgaacgttttgcattctatgatgaagccaaaacagcttactgcatcatttctacaagtgaaaaagctctgtatgcaaatgttatgctgcagaaaggtgttgttatcaacaaataatcatcggccatcttttttcctaagttaccctggagattttcgaatcttcagggtatttttatgtcaactttctgttttcatccggttgcttttattctcatatgtgttatgataaaaaaaatctgttttcaagtgctgctataaacgtttttaaaatcggaggttattatgcattaccataaatcacctaaaaacagacgagtccttgcactgcttcttactggctcgctccttttcggaggaattcccgtttatgccggcgagtacagcaatgttgaattatcagccgaagacgatggttctgatctgacagttgattctgattcagcagctgatatggctgcttcagatgacacagtggcttcagaggatacgaatctgtccattgatgcaacagattccgatgtatctacagacgaggaaggttcctctattgcggcagtcaattctgataaagaaaatgaatctgacgattttagcagtgatgacagccaggaagttttctcagacgggacagctactgacattgacagcgaactggattatgttctcgggcgtccaatgacagatgaagaacgtgaagcccagctcgccatgatcccggaacttaccgatatgcctgtaacggatgaagtcaccagtgatctggatattgtaccctatgcactttatccagaagaatacaactcggcaaaagaagggcttgtcacacccgtaaaaaatcagagttcgaccagcctctgctgggatttcagtcttacctcaaatattgagacctctcttctttcaagaggactcggatattatgatctctcagaagagcatcttgcttatttctgggccaatcgcgtaaatgatcctcttgttaatactcccaacgacaagatcacaagaaccaatgctgattatcacggaaccggaaatggtcaggtggcttccttcttcttaagcacctggtccggtatgaccaccgaagaaaaggtacctttctcttccacaaccaaaacctggccggaagatcttgcatacgacagtgctgcatatatggaggatgctgtcttttcggaatacgatgaagaccgtgtaaaactgcttttaagcgaatataaatctgtatcggcgatgatgtactggaatcttcagaattatactgtcaataccgcagcctattaccaggctgttcctaaactttcctctaatggtaaacagatggtcaatcatgctgtgacaattgtgggatgggatgacaactataagaaagaaaactttatagatggtcccaagccgagcagaaacggtgcatggattgtcaaaaacagctatggcacaggcttcggtgacaaaggctatttctatatggcctatgacaatgcaaccttttccaacctggtctgcaatactgcatcaacttcagaagaatataataataattatttttatgatggtgcttccgcaggaaccgttgtctttccaggtatttccaatggatactatgcttccaatatttttaaggcaaccgccggaaaaggaaaagatgaagagctcggtgagatcgttactgcagttccacaggataatactgattttcagattcagatttataccgatctgacgaatccttctgatccgacaagcggcactcctgcttatgccacaccaatggaatatacgcaggcctttgccggaatccagaccattcggcttgagaagccggtgaagattccaccgggaactctctactctgttgttcttcaaattccgaacggttctcagagatattatctggaaaaaacaagcagcagcagttcctggtttacaacagttgccggtattgatgcaaatcaaagtttttattccgcagatggaaaaagatggacagatgcagccaaatccgagtattgtttctccattaaggcacataccagaaccctgagtacttcgacagtcgtaactcctgatcctgacccggatgaaacaccgattgtttctccggcagtgacaccggcagttagtccagaaataactccggaaattgaaattccagatgacacaccggatacaccggaaccgactcctaccatgacaccaacaccgactcctgtaagtcatcggattaattacaataaaaacagcagtcttggggtcggaaatatgccttctgcatcttccgcacaggaaaaacagactattacagttggaaatgcaccatattgtaaaaccagattttttgccggatggaatacccgctccgatggacggggaaagagctacagtccggggcagaaaatacaattaaaccagaatctcacactttatgcccagtggaatttcacctatgtttcatctgcaaggctgatttaccgggttgtcggaaaacaggcagttacctgctatggaacaacaaacaaaaggatcaccagggccagcattccttcaataatccgttacaaaggaatcacctatcgcgtcacctcagtctgggctaatgccttcaaaaacaaatcgcggctcaccactgtttccatcggaaacaacgtctccgtgatcggcaagaatgctttctacaagtgcaagaagctcaaaaaggttaccatcggaaccggcctgacacagataaactccggagctttccgcggagtcaaaaagggatgcacgatcacgatcaaaagcttaaagcttaagaaggtttcctccaagatcgaccagtccaccagcaagatgaccgtatgcgttccacgaaagaaatacaaggcatacaaaaaaatactctggaagaaatcccggacggtaaaaattaaaaagttttaaatagcaaaaaggaacagggaagatgaaatttcatcttccctgttcttttttgctgttttcttatttcagtgtaatcagaaactgataggtcgtatccttctgaagtttcagaatatcctccgtgcaaatgatctctccgttctccgatttataccatatattatttattgtcctgtcactgttcagtgcataactgccgctgacactcggagttgactgaacgatgagccatttctttttaccctgcagaatcagggttgtcatcgcctctgtactgatctcatctggtgcagcccttcccagaatgatctcctgcgtatcttcaaattcttttcctgttgagacttccttcacaacagcatgacagattttgtgaatgttttgctcctcatccttcgaatcttcatagctaaccgtcagactgtaattcgaatcttctccatccaacaacttttctgatccgtccgaatacaccagagtcacagaatatgctgaaagtttatctacataatcagaaaaaacggccggaactttctccaaatcctgatccaaatttaattttaacgagctaagcgctgcttcatctcatattcacttctattcatcaatgcgtcattctcattgatttttctcaatttcatgtatattttcatcttttcaggctcttcatgtatttcttctgtgctttgtcaagaactcttttgcacagaaaaagacaggggatatctttccagaatattccctgtccttcgccttgcgttcattttaatcttcttattattttatttcttcttattatgatagaccagcaatccaatcactgcaagtactgcaattccgataatccatgtgaacggattctgataccattttgtttttgcagcttttacattctgcccggatgcctcacggctgtcctttgtgtcagagttttctgcttcaggctctttggagtctttttctgtattttcagcttcatctgcttcttctgtaactgccggtgttggtgtctcagtcgcttctgcagcctcagttggtgccggtgtctccgttgcctttgcagtctctgtcggggctggtgtctcggtcgctttagctacttcggttggtgttacactcacttctgccactgcatctacactctcttctactgtatccgggtgttccttcttccattcttcggttttttccagatccacccagccttctgttccgtcaaccgtagttacaccccagtggctgccgtctgccatttctgcatcctgtgtgatatgaagcgtttctccattctcaatatcgcgcactcccggaacctcgccatattttgttccaggtccctgataaagcttctgggaacctccttctgcatctgcctttacatcataatcagcattgtaattcacatgatccttacccgcgatataaagttcagaatcaattgcttcttttctggaatccgccggcctgcactcgtcaagcggggcgtatccatacatgccatgatattctgtgtatccccacgtacggttattctcggtatcctctacttctccttctatatgaagcgccgttccattcggaatctgctcatcattcagcctcgtagattccagatccggctgtgaataaatatcgattcctcctgcctttgattctacgatcatataatagtctgtcggataatccggtcctgtcttgcctgtctgtacatctgccatgacattgacgctcatcagaagtcccagtatcataaccagaaaacttttcgtcagttttttcattttctttttatccccttcactcgcgtgttttcctgtatttcgtaaaccatcataccacagtaccgttataatgataatctttttttgtcataaaaaaatgtaaaaatcaacaaaaagcggaagtttttcgacataatttacggaaagtacaaagaccccggagttatctccgaggtctttgcttatatcatggcacttttgagaaaagccagtttaattatttgtacagaggtccgtaattcttgcaagcgcggaagtctgcaccttctttgtccattccaaatgcattccatgctgccggacgatagatatctttttccggaacgttgtgcatggataccgggatacgaagcatagaacacattgtgatcaggtcagctccgatatgtccgtaggagatcgcaccgtggttagctccccagttgttcattacatcataagctgtcttgaacggtccttctttgccatcgcatcttggagcgaaccatgtgcatggccatgtgtagtctgtacgtttccagagtttgtcagatacttctgccggaagagctactgtccatccttcagcaatctgcagaaccggtccaagtcctttcacaaggttcagacggatcattgttgcaggcatctgagcttttgtttcataacggctggagtatccgcctccacggaagtatccgttgtcagccatacaccattctgtgttatccatgattgctttctgatcttcttctgtgatatcccaccactgtttcataacagcattgccgttttcgtctttagcttcgccgttagcatcgaggcaagcagcaccggagttgatcaggtgaaggaatccgccagcttctttagctacgccttcaaggtcatatcctgtagctttcttaacagcctctgggctccagtatgtacgaacgtcagcgaagatctgagctctgtttgtaaggagtttcatgaacatcattccaagaccgttgagaacgtcattctctgtagcgaggatgtatggctcacgagctccgttccagtcgaaggatgtgttcagcatagcttctgcgaagtcaccgtttggatagaagtctgtccactgtctctgtccctggaaaccagctgccagagcgttgtgtccgattgcttcttcggagaatttcggatcaagtttatcacagccgttcatcagttctttgatgataactgccatcttaactacaaattcaaactgctcttcttttttttctggtgagaactgcagttcttcagggttcttgtcccagccgatcttgcaggtttctttagcccatttcagagctttttcgaattctgcgtgatcgtagataccttctgtcatacgacggatgatctcaacctcatcaacggattcaacacgcattccaagataggattcgatgaaatcggaatcaatgatagatccgccgatacccattgtaacggaaccgatctgcaggtaagatttgcctctcatggaagctgctgcaactgctgcacgtccgaatctgagtaatttttcttcaacgtctgccgggatagatgtgtcatcagcttcctgaacatcatgtccatagataccgaatgccggaagacctttctgtgcatgtgtagcaagtacggaagcaaggtaaactgctcctggtctttctgttccattgaagccccatacagctttgattgtctgaggatccatatccattgtttctgcgccatagcaccagcatggtgtaactgtaagtgtaatgtcaacgccttctttacggaatttgtcagcacatgcagcactttcacctacacgtccgattgttgtatcagcaataacaactttaactggctcgccgttggaatatctcagattttcctcgaaaagttttgcagcggatttagccatgttcattgtctgctcttcaagagatcctctgacatcgagtgctcctctacgtccatcgattgttggtctgataccgataaccggatagctgcctactaatctgctctttgccatgattcattacctccatttaattaagtactttattatacgagaagtttttactaaaaaatctcgttgtttcctatatttcatagtatacaattgccaaacgttaattacttgtgttataatagcaaaaaacagtacaatattcactttttttaattattttgtaaaaaatctgtgaacttatgataaggaggcacttattttgcacgatctggaccgcaacgaggaccgtttaagaggaacttatgattttccatttgaatttcatcatatcgaccacaatcatccccgctacgtgatgtcctatcactggcatgtcgaatatgagattattcgtattctggatggctcactcactgtcactttagacgaaaaaagttttactgctactgccggagatatcatttttgtgcatagtggaatcctccacagtggaattcctgaggattgtgtctatcagtgtatcgtctttgatggaaacacttttctcaaaaataattcagtctgcgccggatacatgcagaagatcattcatcaggagattttgatctatcatcatttcactccgaaatatgtggacatttgtgcaactgtaaacagtctttttgacgcattatggaagaaaccttctggttatgagctgtctgtgcttggacaattttaccacttttttggtctgatttttggtaatcattactatctggagagtgtcacacgcgcacgccgcgattacaaacgaatcctgcagctgaagcaggtcctggatttcatcgagcacaattatgcttctccactgacactgcagcagctttctgcctctgtatccatgtcaccgaaatacttctgtcgtttcttttccgagatgacacatcagactccaatggattatctgaatcaccagcggatcgaacaggcctgttatcagctttccaccactgatgactcgatcacggagatcgcatatcgaaatggtttcaacgatctgagctattttatccggacattcaaaaaatataaggggatcactcccgggaaatataaaaaagcatagcatagaaaaagagctctgaggactcacacctgcgcgaatcttcaaagctctttttttattatcacatttaaaacagttgtattacagtacctcattcagtacagataatccatattctgcaaggctgtgatcttcttcaccggtaccaccgctgattcccagtccgccgatgatggtatcacccactttaagcggaactccaccgccaaagattacgatcttgccattatccatcttgtctacgccatagaaagttccaccaggctgagccagaacgcttaattcttttgtggacatcttgactgcaacagatgtataggctttcttagttgccacatcaaagcttacaagaaacgctccatccattacatggacggcgattggatttccatccggtccacagactgcaataacagccttcttaccgcgacgttctgcttcctgttcgatcttctcgatcagacgtttggcactggcaagtgtaattcttccctgaatgcccattctctttaaaacttcctggatcacagcttcattgactgctcctgtctgattctggttctctggcatggttctgacctcatcttttccaccgtccgatgttttttctgtcggtttatccacctcttcggcagacatttcctccatctttgcatcggtatatctggcaagtatataaagataatctgccagccggttcatatatttcttagctccgttgtccgctccgaatttcacactgactgttgcaagtgctctctcagcccttcttgctaccgttctggctacatccatttcagcagacagacgacatttgcccggcaggataaattccttcggtctctgaaaaaggccttccatccggttgatctcgtcttccagatattctgttttaacgtcgtcaatcctatagtctctcttgtaaggatctgccacccctgccatgaccgtgatcagtgtacgctggatcttctccagaaactgtatcgtgtcttcatccttcagcatggtcttaaccaggcccagatggctggtcagttcatcaatggttcccaccagctgaatgcggtcatctgacttggagacattttttgtatggacaaggcttgtcgttcccttgtcgccgccttttgtataaatgttcatcttggcatctcctgtaatgtttactggtaactattttactctcgaaaaataaaatatgcaacaggttattctcccctgtaaattgctttaaatggcatctttttaactgctcttgcactgtttgcccccagatttcggcactgccagaaacgtggtgcattcagttcaaatacgttatgtccttttggaagacgtctcatctgcatggcaatcctctgaccactcattccgatccccgatccaagcatggaatcttctgctgccgcatgagccagttcatccagctccccggctctttcatgaatctcatacagaagtccttcttcttcgatcccggaacagatttcatgaagaaactcctgatccggatcatttgtataaataatgatcgtcggtttgtttacaaccactgttatccctcctggctgtttcctatgtaggacagaagcagaccagtagcaactgcgtttctcggtccctccgttccacggatatttccacggccacatacgatacgatactcggcaagtgcctgcatcagcatctccggaatctcaaaatcctctgcggaaccaccgaccagaactacgtttggaatgtttcgaagttcatgctccggtgctacctgacgaagtgcacgtaccgcatttcgtacaaatactttgcgttttgcttctcttctgacttcaagaatccgttccatcggaatgtcttcttcaatcttgagcatctcgcccggtgcaagcaaaacaacatgtccgtaatatcttggatcaatagattctgtaaagaactgcatcgctccattttcgaggcgcagatggaaaaggctttccaccttgcccaatggatatttcttgatctgttctgctgtagtacggctcttaagtccaagttccgtctggatcagcatcgttaccagctcaccggcacctgcctgatgcgtggtgcggactcttccgtctgcttccagaactgcggcatctgtagagccgcctcccatatcaaggatagcaagcggaagtctggttcccggtgttgtcattgctccaagtgaagccataactgcttctactccggcaacaacagctttggtgtgaagatccttctccagctgctctgcgatcttctgcattggaagatgtgctgtcttgaccattgccgcaatccccacggctttttccatacaggtctcgcctgcaagcgcacctgagatctcaaccggtgcaagtgtatccactgcaagaatatctgtaatacgcactgcatgattttcggcttccgccacatctgccatgctcgtcttaatacgtgaaaacatatttcctacattggaatccggctgtccatcaatatcaaagatctcacctgcatcctgcagcgtatccatgatctcatcagccccatgatctatatttattcgtaattcctgctctccgtgaaagaaaatctcaccagcaggaagaatgttctcttttatgtttccgttcggagtacggatcacaaccgcacttcttttgccgatcagactcttggcgatcggagtgactgctcttgtctcatctgcatccagtttcagaagtgtagcgattccatatggattggaaagcatccggatacttgtacccggaagtgcaacctcgattgctgccattttgtattcaggcactttatcaatatggcgtacttcatcaacgatcggaatttttttgtttaagcggttttctaccaggactgcttcatctgcctgaaggatcagtccgcggatatccagctgctcatactggttcagtttgcgtgccacctcttcataagaatactcagaggatgccaccagaatatatggtatattcgatctgcctttgtctatgttctgaataaacagaagccgtcctactgcttctcctgcacctgccggtgttgccggattgtgcccgatcatagaggactctgtaatgattgtctctgtaattgtttccattgctgtatcaccgataaccggagctgcctcgttcagtcggacaagatccagtttttccaacggcataccgatacggtgcatcgcttcctcaagggcagctttgaccccgtgaacattcggaagtgtccctttggttccggtggtaatacgggaagcactggagaggaactggaatcttccgtcctctcctacacttccgatacatacttcagttgtggaatttcctatatcaacacctgcgatcagtttcaaagaagaattccccttttttcataaatttctgcagcctcaagtaccagtttggcacagtgaggtgcgctgtatttctgaagaagttcctgcgccatcaggatcagttctttcttggtggaacgattcggacgcagtttgttgtacatatcaagaattacatcatcaggtacatttacaagctcggaagcacgctgaaaattcgcatccatagttggattatctgcttcctttgcaacctgtccctgtttctttaatgtttcagcggaaatcttaatgtcatcggctgtgacatttcctttttttacttcatccagcgtgatctgagaaagctttttgccggttcttgaagtaatggtatccgcttcactctgtcctaaaggatagctgctcattttgtaccctcccattcaatcatgcctttttccggatccagctgctctgtctcaataatatgaagaagtgctgcttttacctgatattttgcacgtaccattggatcgttggtacattcgatcggtgttaccttttcgccttttacatatttggcagcattacgtccaatcttacgataggtatccagatccatcagtggtgcctgtggaaaaagctccagattggacagtggatacagatctttctgatggatgacagttgttccttttgactgcagaccaatgccgattccggatccggaaagcttcgctgcttccagtcccataaatcctacatctgaggtatccagcactttgacaactcttgatgtcataccttcttcctcgattcctgcacagatattgcgaagaacttcctccagtggaatgccactcatcgtcttggtgatctctgtctggaatgctgcgccgactccgatcacaacttctttcggatcagtgccctttgaggcccttaccgcaccttcataagaatgtttcggacgcattcttgtttttccggcaaaacttcctgttcctgccggtgccggtgtactgctcacattctgaggctgtgcaccggatgccataagctgtgcaacgactgcctgtgttacggcacgtaccagctgctcatttacttccatggtgcacctccttaaatatcatttgcgttgattctgtgaggaatcgctttgatctcctcccaacgcttacctgaaactcgataaccggttcccggtcccatgtaatcgtttggtgtatttactccggacattacctggaaatttttatccaggattgctgccgtctgcatataatcaccgattactctctgtttcaacatgttgagaatattgtctgcaagaacagtatagccactctccgcaagcgctttgactacatcaattcctgtaatacctctcttcatcatgtcatctgcagccataaggtcggatgccacatctcgtttgagtgtatctttgcttccatgcgcataggtaactgcttcaacctgctcatctgtcacttctgtaaggcccagatatttaaagactgcctgaacagctttgcctgcttcatgacgaacacggataacatcttcctctgtaacaggacgaagaccgccatccacctgcatatctctctgcaaaacattataatcatcaaagtcctcggcatcaaaattggatcccgcgaacatattgtcgtagtttggttctgctgcatatccggagaaaataaagtctgttcccggcataaactgcagcatggttcttgctgttcttctcatatcggagtttgagaagctctggtcattggaagatgcacattccagtccgagaagtgctgcaaccagattctcgcccataacttcacggattcccgccggaacaccggcagcaacaccgatacagcttacagaaccattctgaattccctggcttccgcatccctttgtgacatagagacagcggcattccagataaagcatggatttcttttcactgcttcccatcagaacttcagatccggcacctgaggtgaaacggactttcagtccacgtgaagcatatgcggagtttaagaatgctttggagtatggtgtatcatcaccatctacaaatactttttcggttccatatacagaaagtgtttctgcataagttgtcaggccacggataccaagctccagctctgttgcctcttcagctgaacactgtgtaaggacacccggacgtcctgtctgtgaaccgatgagcaatgccattgcactgaacggtgcgtatctggcaacacccattgttgtttcttcttcgctgaagcctcgaagggctccctctgctgcatctgctgcgatctgtaccggatcatctttcaggttcgtgatatgggcctgatttccaggtacttttctggcacgcattttctgcatacccatcatcagctcaacaacattcagataattaattacttcaaccattttggccggtgtaataccggaaacgatttccagtatttctttacgtgatacatgaatgtccacgatctttctggcaatctccagtgatggaattgccatggatgcttccgcccggtccgcacggatcgcataatcagcaataaactggtccaggaaatcaaactcatcgcgtttctttccgtccagttctgtgatgataccatcttctatttttacagaaggttttggatcgtatgggctgtgcattgacacgaatcccatttccggccactcatcaatgaatccatctttgttgaccggtctctgatccaaaacctctattcttttcgatcttttcataggtctaccttcctggaaaagtcatgttttataaaattagaaagaccagagtttcttgtaaatcttcataatatcctctttggtcggggttcttggattgcttggcgtgcacgcatccgcaagcgctgcatctgccatcttatcaattgctccgaagtattcgtccgggctgatagttccaatctcctggattgtcataggaatgttcatttccttctgcataaactgaatccagtttacaagagaacgaacgctcattacctggttgtagttgctcagtcccaggatatgtgctacagatgcatatctttctactgcaggaagatatgttttctggcttctgcttctcttgttgatatttgcattaaactcaacgatatgaggtaaaagcattgcattagctcttccatgaggaatatggaactgtgcaccaagctgatgagccatactgtgtgtaattccaaggcccgctgtattgaaggaaagacctgccaggcaggatgctacatgcattttctgtcttgcatgcatatcacttccatcaagataagctctcagaaggaatacgccgcaaatctccatcgctttttctgcaagtgctgctgaaaactcattatgtcctgtacttacataagattccagcgcatgggtaaacacgtccatacctgtatctgctgtaatagccggcggtacgcttttaactaattctgcatccaggattgcttcatctgctgtaaggtctggtgaaacaagtggatattttacttttgcttctgtatcgtttacgactgcaaaggatgtaacctctgaaccagttccactggtagttggaacggcaatcagtcctactttaccgtagttgttgatcttcagtgcaaactcacggattgctttagaagagtcgatagcggaaccgccgccaacagcgacaactgcttccggctgatagcttaagaactttttaactccgtctgcaatcttatctacaggcgcatccggtactacgttgctgaaaatatcatattcaatgccgccttttgccaaaggctctgtgatcagatcaatcattttgctctgcacaacaaatggatcggtgataacgagaactcttttatatggaatctctcttaagcgatctagagcgttgtctccaaaatgaatgactgttttcattccaaaggtcttcatatctgttgcttcctttctatggctgcataccaggataacggcactctacgccttcttcggcaaaatgtgccagccacttctcagatggcttcctgtctgttacaaccacatctatatcccgcagttttcctgcaacggaaaatgcggtctgatcaaattttgtactgtctactaccagaatcttctcacggccggacgcaatcattgcttttttggtcgtgccaaaagcttcctgcgattccatgatcccccattcatgatccagtgccttgcaggagatgattactttgtccacataataggaacgaatcgcatcttctgtctttgacccaagaaaagcaagatatccctctttcataacgccaccggtggaaatgatattccatcccgaaacatcagataattccagaaggatctccatggaattggtgatcacggtgagtctttctttttctttcagtgcctttgcaataaatactgcagtggtactcgcatcaagaaaaatatgatcaccttcctgcaccagagaggctgctagatcagccatctgctgtttgccgcttacattctggttttttcgaatattaaagggcaagtcaatgcttacatcctcatttataacagcaccaccataacttttggtggccagtccctctttttcaagcttgtcgaggtcacggcgaattgtttcttcagaaacctcataaagctgactgagttcgcttacaacgacccgtttctcagcctgtaatttctcaagaattaaatttcgtctttctaatgccagcatttactttgcccccttttgagaacatttattttatttcttttaattcattaaagaatagaatcgatcattctctgatccggatgagcaattactgaagaatccagatacattcccttggatgctacaagctgttttgctttttcgatggaagcttctactgctgaaacttctccggtaagaagcatgtaggattttccacacataccttttgcaatacgtaattcgataacatctacgattgctgtttttgctgcctggtcagctgcttcgatgatagaagctgcatcatatgtttcaaggattcccagagcgctgatcccctcgatctgtgttgttccatacatagccgggaagagagactcatgaggattaccaagtacaaaactgtcgatgcatttgtcctcgtaagtagttactgcagcgtcaactgctgcttttactgcacttaaatcgcctgtgataattgcaatatattttcccggacatacggtctgtgcctcgacgatctctacttcagatgtcttaaccatggcatccgctgctgtgatacctgtggcagtggttttaaattcaatcattccgattgctttactcattttctgcacgtcctttctactttgctgcaattatgatgtggcggtctgttacttcagttactttaccagagatacttgcatgaatgcttacgcttaatccgtcagcatgctgtgcgatcatctgtcccttggttaccatgtcgcctgttttcacaattgcctgtgccggtgcgccgatatgctggcttaaaaggatcttaaccttggataccggaactacattctcatccatcggtgcatccttatcgtattttgtcagtccgaggcgagccatcagacgttcttccggaaccttacgatattctcgtgaaggctgaaccggtaccggctgtactccctgaggaggtctgatacctgcttttcgaagtccgcccttcatgtctgcaagaagtgttcttggcgccagactctgtgggcaggcatacatttcacatacaccgcaggaactgcagaatgcagaatcgatgtatggatttacatctctgaaatctccggcagatgctgctctcataaagcgggccggatcgatcggatgtccaagattatgtcttgggcaaaggtccgtacaggtattacactggcagcagatagatgctgcacgttttaaatctattgctgatgttctctgtttcttcataacgatctgatgatctcttggaagaacgagaacagcgtttgttgttttggtcaccggatctgctccgttgccaatgcgtcccatcataggtccgccaacaaaataaacaggatctttggtagtaatattaccagcctgtgctactacttcgtctaaagtacatccaagcggtactttaactgtaaccggatgttcaacttctgctacgactgatacgtatttttctgtaacaggtttctgggattccagtgcctgatatacattgtagatcgtctctacgttgaatacgatgacgccctgctcaatcggcagtccgcctggtctgcatacacgtccggttgcttcatagatcagcacaacttcatcacccatcggatatacttcatcaagaagatgaagtttcagaccagggaattcttcaatgtgctgctgcagtgctttaactgtctgtacatatgatttcttgattccgataatggcctgtgaagcaccaactgtctccataaccgtatggaaagttttcatgatctcatatgcatgtttttcaagcagctgtctatgaagtttcagcaatggttcacactcggcacagttcaaaagaattgtgtccgccttgtctgtaagcttggcatatgacgggaatccggcaccacctgcacctacaacaccattgtcctgcataattttctgtaaatctttgatttccatggcgttactccaatcctgcaccatcatcgacgattccgactattgccgcatcgatcggtgctgtttcttcgccgcagccaattcttgctgcgcttccttgtgccaccaacacatattccccgatacctgcaccgataatatcgattgcaacgatctgggataagtcagctttcatatgatgcaccggctccacgatcatgaatttctgtcctattaacttgtcgctcttccgcgtggaaaccacgcttccaactactttacctactatcatgtgtgtgcctccgcatgttattcctataatccctctatgccggtggcgtaactgccaccggctgattctgaggaattatttactttatgatggtaactgtattgcctgtggcaatctttgctgcattcgcttcatctgtatcaatatgcatttccagtgtaaagctgtcgtctacacgaattgcaacatgattaaagattgttccgcgctcattatctgctttgacagatacgatatcaccgtttttcactccggctgcctgtgcatccttcggagacatatggatgtgacgcatagccacgatacatccctctttcagataaatagcacccttcggtccaacgatcgcaatcggtgcgcttcctgcaatatctccggacatacgtaccggaacgttcattccaagtttgatagcatctgtcgcagatacctcaacctgtgttgcactgcggactggtccgagtacacgaactttctcgatcgcacggagcttcagaccaacgatcgtaacagtttcatttgatgcaaactgtccacccataagatcttttttctttgtgagctgatatcctggtccaaataatgcttctacgtgttcctgagtcagatgaacgtgtcttgcagatacaccgattggaaccatgaagccgttgcctttgtcttcagactgattgatggcatcaattaccatctttgtgatcagttcgatgttttttgattccaagattacacctgctttcttccgttttcaggaaatatattatttcagtaccggaaggattttttctacgtctgtgtgtggtctcgggattacgtgtgtagcaacgagttctccaagtctggatgctgctgcgcttccgctttctactgcagatttaacagctcctacatctccacgaaccataactgttaccagtccggatccgattttttctgttccaacgagtgctacgttagctgctttgcacatctggtcagctgcttcgattgctgctgtaagtcctctggtttctaccattcctaaagcttcctgtgtcatgattatttcctccttatggataaatgaaaattattatttattttctttttttgtttcgtcagtttttttcttccaacggcttgcacttaactccacgagcttgacaatttcttcgtgaggccgtgcgattactgcataactcgccggtttctttattgcgcctgccacagcagcttcgactgcttcgtttactgctgatacatcgccttctacaataagagttaccagtcgtccgcccagcttacgttcccatgacgccagctcaacgtctgcagttttacacatgatatcgagtgcattgatcgcagctacgacacctgtgatttcgataaaaccatatgctttactcatgagcgaactccttcagataagatatgtaacttatcagatctttggaagaattttttctacgtctgtgtgtggtctcggaattacatgtgtagcaaccagttctccaagtctggatgctgctgcgcttccgctttctacagctgctttaactgctccgacatcaccgcgaaccataactgttaccagtccggatccgattttttctgttcctaccagtgctacttctgctgcttttgtcattgcatcagctgcttcgattgctgctgtcagtcctctggtttctaccattcctaaagcttcctgtgccattgtttcttcctcctgaatcattgttcgttaattgatttctaatatgccagggatatcagctgtcagcttttatccagggcgctgattttcagcatctttaccgtatcctcggtaggattcggtattacgtagtgctgcactacaccagttctccggtttgcttctgccattcctgcttccacagctgcggttacgtcttcgacgcttccgcggaatttgatgcataccagaagcggtactggcaggctgtcagcgtttgcaggtttgttcttatcgaacacctccaggcggacattggctgccttgcatcctgcatctgccgctacaaaggctgtcgccagcccgaatacttccaaaattcctacagcttctgccattttgcttctcctttatttccggattatttattaatgatcgcgatcttaagacctgtcattgcaaggttagtcttatgagcttcattgatctgctcaagcgggaatctgtctgtgatcagatcagacatcggaagtccgattgcttttgctctcttgaggaaatcaaatgttgtagcataatctctcagtgtgtatacccaggaaccaaccaggttgatttctttggagcagagatcgaagtgcgggttgattgtagcatctccaccattgatgaagaaaccaagttcgcaaagaccgccgccgttacggatgaatttgtagatgtttgcatgtgcgtgcgggttacctgtgcactggaatgcaaagtctgcaagatgtccgccctgagcttctttaacagcttctgtaagagcttcgattcctttgtactgtgtgaagtctacggatacttcagcgcccatcttcttagcgaattcaagacgttttgcgtttccatctactgcacagatgttttcaacacccattgtacgaaggatagcgatgcagataagaccgatcggtccgcatccctgaacaacaactcttgagttgaatttcaggattcctgttgtttttgctctttcaactgcatggataagtactgcacatggctcgatcaggatacgggaatccagatccagatcacttacgttgaagaatgtagatccgaaggatccgcctctgatcaggatgtaatcagagaaccatccgttaagatgtacatcatcatctggaagaagtccgtatacatcagctccaccaacgtttttcttgttgaggtcgaacattgtgatttccggatcatctttgaagatcatacatgtaacaactttatcgccgactttaactggttttccagctgtatcaactttaacgtttttacccatttttacgatttcaccagttccctcatgtccaagagcaaccgggatcaggccaaatggatctcttttgaattcgtgtgcgtcagtaccgcagataccgcatccttctactttaacaaggatatcgtcatcgccaacttccggcattgggaattctttgatttcataatgttccagtgctgtaagcattgcaacatgtgctgtttttgggattaccgggtcagctgtcggagctactggagctgctgctgccggagctgctgctgcagccggtgcatttccggtcattccggaaagaacctgttttacaatttcttcgatatttacattgttcatatccattttaatatttcctcctgattagcgaatgcaaaggctgtctgacattacgcagcgtcttctctttgtaaaggtgcttgcacttgtaagtccctcacctgtacggcttgcgattgtgaaagtacagtaaccttctccaccaaatccaagtgcagaataggacgggccattcttaacaaggattgctgtatcgattgctttcgcatatttggtaatgttgtcaacattcttggaatggatgtgtgctgaatgacggttgccatgttcaagccatacagcctgttctacagcatcatcaaaatcttttgctcttacgattccaaggattggcatcataagctctgttgtgataagcggatgttccttcggtccttcgaagatgatgcaacggatatttgccggtgcgtttactccgatcatggaaagaagtgttcttgcatcacgacctacacatttacggttcagtttaccgcctgccagaacaacttctgttaatttgtcctgttcttctttggaagccaggtagcagtcgttttctgtcagcatgtagtgcatcagttcatctactacagaagatacagctacaacttccttctctgcgatacatggaaggttgttatcaaatgtacatccgtttacgatgtcctgagctgctttacggatatcagctgtttcatcaacaactgccggtgggttacctgcaccagctccgattcctctcttaccggaggaaagaactgctgtaacaactccagggccgcctgttgctgcgatcagcgggatatctttatgtttcatcatgatattgcttgtttcaagcgtaggtttctctactgttactgcaatgttgtccggtccgccggcttcaagagaagcttcgtttaccagattgattgcaaagatagaggtcttgattgctgccggatgcgggttgaatactactgtatttccgccagccagcatacccattgtattgcagaggattgtttcactcgggttggtacaaggtgtgatcgcaccgattacaccaaatggtcccatctcgatcagagtaagtcctctgtctcctgaccatgcagttgttgtgatgtcttctgtaccaggtgttttgtctgctaccagatgatgtttcaggatcttgtctcctacgttacccattcctgtttcatcaacgcccatacgagccataacttctgcgttttctttgatttttttacggatgcaggtgatgattttttctctctgatccatggacatcttcttaacgatcagttcagacttcttagcagcctcaattgcatcgttcatatctttaaagataccatgttttcctgtcggagcatctgcaatctgcatttttgccattacttcctgtacaatgtcctgtaccatgctctcactaattggcatgagattgtcctcctttaatgtctaccacttaatatggaatggattatttcattccaagctgtgccataacctgttttgtgatgtttgcaaccagttctgcatcagctgctcctgtagctgccggagcttctgctttagtttcgcttcctacgaaatcatactgatatcctgggaactgtttgtaatcctggctgtgacaagcgccaccgcagttatgacagttaacaccgtctttgttctggcaaaggtttgcaggatgttttcctggcataccgaatttacgacggatttcatacagtttcttgatattttctttgtcgaattccttcgggccaccgagcagtttgctctgatacagcagctgtgcatagaattcaacggattccatcttcatgtatgcagcgttcaggtctgtgctccatgtaagagctccgtggttctcaagaagaactgcatcgaagtatggaagatatttttcaaggttgtccggaatttccattgtggaaggtgtaccgtactcagcgatcggaacacatccaagagcgataactgcttctggcatgatcggctgtgtaagcgggataccagcgatagcaaaagatgttgcatagatcggatgagcatgtactacagatcctacgtccggtctcttctgatatactctcatatgcattttgatttcagaagatggtttgaatcccgggttagcctgaattacattaccctgagcatctactttacagatgaactctggagtcataaatcctttggatacgcctgttggtgtgcaaaggaattcgttgtcattcagctttacggaaatgtttccgtcgttagctgcaaccatgttacggttatagatacgtcttccgatgtcacagatctgttttttgatttcaaattcgtttaccatgcttattttcctcctaaagcaatttggttttttgcagctgcccgtcagctgaaattcagtccctggacaaccactttggttttattgtacttctaaggagattttactccttataaacaagattgtcaagattttatcgttgttttgtgttgtttttatcacgataaaaatgttgtttttgttgttttctgttcatccaccaatctgaacatgcagagaacttacggattctgctgctttcttcaacgtctgcatatgttcctgtgttggtggaagaattccttccattaaataaggtcttccaagtccgatgtatttatcctgaccaagtctgtgatacggaagcaggtgaagctgttccacacccggaagtgtatctgcaaaagatgcaattccctggatttcttccactgtatcattaaaagtcggaatgaccggaacacggatgatcagcttacatttaccggaaagtgctactttacgggcattttccatcataaggtcatttgcccgtccggtaaattctttgtgttttgccggattggtatgcttgatatccatcagatacagatccagatacggaaggattgtctcgatcgtctcaaatggagcacaggccatactttccagtgcagtattgattccccgttcctttgctgcccgaagcatatctctggcaaattccggctggcagaggctctcaccgcccgaaagagtaagtcctcctccggagcggcggtagtacggacgatcctgttcgactactttgatcatctcttctactgtaacatctcgaccgattaccttgtctttgccaaggactttcattgtctggattccgtattcctgtgattcagggttgcagcaccatctgcatctcaacacacagcctttcaggaaaacaatcgtacggattcccgggccgtcatggatcgaatatcgctggacgtcaaaaatgcggccttttgtctgtaaataactcataatttacctcttagaagccctgttctgttcttctgatgatatcatcctgaagagaacgtgacagtgttgtaaacaatgcactgtaaccggcaacacgaacaaccagatgtgcgtatttctccggatgcttctgtgcatcgatcagagtcgctctgtcaacaacgttaaactgcatatgcattcccttctgatcaaaatatgttctgatcagagccacaaatttctccagtccttctcttccggcaagtgctgacggatggaatttctggttaaacagtgttccgttggatacgataaagtgatccagtctggaaacagatgttgctgctgccgtcggaccgttgacatctttacctgcagaaggagaaacaccatctgctaccggagtatgcgcataacggccatctggagtagcgcctgtctgtccgcccagcggaacattcgcagataccggataaagtcctgcatggaactgtcctccacgtggattatgatatttctgaagaggacgtgtataggtatatgcaacatctcttgcaaaataatccacatcatcgatggcatttccgaatttcggaacttcatcgatcatatcatgcagttctgtaaatttctgaatctgctcatcggaaggtttcagtctcataactgtctgaagaactgcttttgctgtatcttcgttgacagtcattcctgcatcctgcattcccttgagaatcatttctgacatatcggcaacagttttttcatcaaggcctttgtcgtagttccatgcgagcgcttctttataagtctccatggaaactttcttatcttcataaacaagcttgcggatcgcatacagggaatctgccatattcgcaataccaaatccctgcggaccggtaaagttataaaccgctcccccctgctctgctgtaaggccacgggtcaggcagtcatctaccatggatgcaaggaacggaagcggacatctctctgcatgtgcaacatcgattgcattatctgcattgaccatcagagaaatacagtattccatctgtttcttgtatgcatcatagaattcgttgaaagtattcatcttggtaacatcgccagtctgaatgccaacctgtacacccttgtccataccatttgcaaaaacaagttcaagcggacggcacatattaaagaacgctgcatcatgccagccgtttgtcttaccggatttctgcggttcaacacatccgatgatgttgtattctcttgcatcttccagagtgaggcctctgttctgcagtgccggaatgataacttcatcattatagtaagccggaagtccgataccggttcttgtaaggtcagctgccttcatcagcagttcatgcggagaaccattccatacacggatcgacaaagacggctgcggcaggaatacctgcttggacgcctcgatacacataaatgaaagatcattggtaacatcttcgccgtatttgttctgtccgcctacgatcaggttctggaaaaggctgtatcccgcaaagcccttagctgattcttcatcacgacacttgttcaggtcattcatcttaacccagatacagtcgatcagctcctgtgcaaactctcttgtgatcacacctttgtctatgtcttccttataataaggatacatatactgatcaaaacgtccaggtgaaatggaatgtccactggattcaatctggatcagctgctgtacaaaccagaaagactggcaggcttcatagaagcttgtagctccgttcgccggtacacggctacagttttctgaaatctgcagaagttcctgtttacggaccggatctgtacactctgctgccatctgggatgcgagttctgcatatctttctgcgtattcgattgctgcctggcaggaaaggatcactgcatttaagaaatggctcttcgtaacatagttggcatctccaacctgacacttatccagctctgcctgtgctttgtcgatgattcccttgtatccgattgcaaggacttcaccatatttaacagttacgtgacctacaccattgtagaaatagtttccaggtgtaaagatattgtgttcgattgctttgattgcttccggatccatataggatgtagcaagttcactggatgtcttacccttccagtatttatgtacttctcttaactcctgcttggtctcttctgcaatataaaacgggtccgcgctcctcgtttcaacggtatccagctcatcttccagccactggaaggaaaattccgggaatgtctgacatcctcgcggtgcgatcgtgctgcttccgacgatcagttcattgtcacgaatgatgatcggaatattacggagaatgtgagcaaaagcttccgcacgccgtgtgaccatcggctcaccttcggtagccttatatgattcagtaagcagcttcgctctggcagactcgattaccggcatattggcataaagtgcctcaaccagtttcggaatcctggatgactttggaacatctgtggtattaaacatctccacgcttctcctttcttatggtgtcactaccttaaaggtatctcttacaccatatctcatatgcaatcagaaggcgctaaaacgccacgattcatatagaatcattatactctacgtgctctttcatgtcaacgaaatccaacattattcttctgttttttacgaggtttttgttgtggtttttattggttttgtgttggtttttattttgaactgcatttttctgttgacttttgtgatagtgactgccatactggagttaatgatatctttgcggtcagattttatatttatctgccacattttttcgatttattttcgatctaaggagggatcttcatgtatctttctgatatacatacgcattctatcgcaagtggccacggaaccacctgtacgatttctgatatggccaaagcagcctccagaaaagggctgaagttgctcggaatcacagaccacggtcctggaacgctggccgctggaacttcttcttatttccgcagtctgacttatgcgccgaagaagcgttttggaattgaattgctttttggagtggaattaaatatcctggatattgacgggcatctggatctaaacgatgaactgctcggagaactggattatgcgatcgcgagtatgcatgcacagaattacaatagtggaacgattgcggaaaacaccagtgcgtatctgaatgccatgacgcatccatgtgtcaaagtcctgggacactgtgataatccagcttttcctgtagattatgagactctggctgtcggtgccaaagagaatggggttatcttcgagatcaatgaggcttcgcttgcgccatatggatatcgtggtgatacaagagcaaacaacagggagatcctgaagtattgtatgaagtatgaaattccgatcgtgctgtcgagtgacagccatggagtggagcatatcggggactttacgtgtgcggcggagtttgtgcatgagatgatgttttccgagaaaatgatattgaataatgatattcctcggttgaagatgatactgagtgagaggtaggaatcttagattctataataataataataataatatatatcacgaaaaagtaaacagtctcctgacttgttgacacgctgcatttccggattcttcccgcgcatctatcgatgactgcttttgcaaactcgcacccaagggtgctcagacagtgcaacgcagccatcattagcgcagtcagaatctacggaaatttgctgagtcaaaatgtcaggagactgttcctttttctgtgtataggaatatgaagctaaattaagatattttctatatttatctgaagattttaaatatatgtatactattaattcctcttctctcattttccgtatcatctttgtggtgccaccacaccccggcggatgttcacggccttcggccgctgccccgagaggccttcccggttgtggggaagcggaactgtcgcaagaaaatgatcctataaaaagctttgaactgataaagcatgcatccgatattcaggaacccagcaaggctttcgagactgcgactgtgctagtggcggttgtggagcatctgtctgagcgacagcgagttatgcggagcaatcgctaataagcgcacgggagcagcccgaaaatgaagcgtgttccagaatatcggatgtatgtctatatcataatccgtctttttcttctcgtatcttcttcatcagttccgccagctcgctgtatttcccggttacgtaaccgtagttctgggctttatgtggcagctggcagttcgtgcagtcttttattcctgtttctgtcattcgaaaattcccgccacatttatcgcccagtgcatacagcgggcagtagcagaacagacagttgaagttctccggatctgcgcctgcatgacacggaaaatattcacattctttattgctgaaaaaagcatagtgtttcccttcccaatatggttttttcatttactttcacctcgttatataaaaaaatccagtcacggcactgccgaactggtcatcttcaaaacttatttcagaggatttgcgatactgctccggggtagacaatgaatccgttcaaatatgcggagggaacgaatgcatccggagtagtaccgcctgccatttaatcataccctttaaggggtcgtatgtatgtggcggccaccacgatacatataggtataattcatacgaacaggcgaattccataaaaaaatgcctgcttccaacaagcagacaacgctttgggttgcggataccctaagttggttgttacactttacacggaagtttaacctcgccatacaaagcaggtttcctgacttcaggatcatcacttcttttccccttctcatactatcgtacaatgggatatcgaaaagtcgctcctctgttacagtgaccggatcgctcaggattctcacctgattccctcttctgactgctacgcggattacagtcagcacttcatatgttcaatatggaattatactgacatcataatagcacgatgtcagtatgctgtcaataacccacataacattttgtcaaatttttatcattttatttacataccgcatttctttccaacacgcagtaacttcatctgtttcaagaatgcctctgcattcttgctgcgagatgcgcgtcatgtaatgcatgacatacttcttctgcgcatctctgcaatcctgccggaggctatatcagatgggggattgactcccaccactgatactgatttgttgctcgccacctacagaggtgggagtcatctcacatctgatataaactcctcccttgcattttcccaacacctcacctatactgaatacagtctgataaagcagtaaatacagcttttcgataatacagcccatcgccagacaataaattgcactctatttttcaggagggtccttatgatacaggatattgcaccacatacttatcacaatgaatacagaccggttgctccggatggcagcagttttgtgctcgcttatgaaaacggaaagagtttctttcataaaaatgatacagacaattctataacgcttccccgtttccgcgaactggaaggaaacgtaagcgacctgtacaaaaattatatctatcttttctcgatagatgacgaacgtttttatctgattccgggactggatacttccctgctgccaggctatgaattccacgaaaacagagagcttcgttatgtacagccacagtatcttgcttttgcttcgattaccggatatcagctctggttctggtacagaaaccgccgtttctgcggatgctgcgggttcccaatgaaacacgatacaaaagaacgtatgatgtactgcccttcctgtggccgtcaggaatatccggtacttatgccggctgtgatcgtcggtattactaacggagataagatcatctgttccaaatatgagggcagaagctttaagcaatatgccctgatcgccggtttcgcggaaattggtgaaacaattgaagaaaccgttcatcgcgaagtcatggaagaagtcggtctgaaagtgaaaaatctccgttattataagagtcagccatggtccttctccggtacattactttttggatttttctgcgatgtagacggggacgatactctcacggtggatcatgaagagctttctgtagcacagtggtttgaccgtgacaaaattatctgtcaggacaccggcagcagccttaccaatgaaatgatgatggtcttcgccgccgggaaagagccaaagtgatttttttctccatgttccaattgattttaagtcaattttttcgaatattcagattgacattttctctccaatattttatcatctatataaaagaaatgggttttgtatcgtgtacagccttacggctcaagcgagttgctcgtttctttttttatgtctatgatatcatacaaatacattctattatcttccgaatatcttactataagtgatgcatgaaaaatattatatctttctatctcatcgtctttatacacaggaagtgcaaacctcgaattatagcgataccaaccatacctcgcatttctccaatgcttgctctctttattttctctataatatttacccaaagctatttctatcatttcaggaattccctgtgttgcatttgctttcgccttggcatttgttcccttaagactatgtgtatatttcgaaccactatattcatttggtaaatcagctccaatatatataacatctccagtagaagccaccatacaaaaatccccaacatattctttcaagtatgcacgtacttccctccaattgatggagcgttttcccttaaatctaatatcattgatcaccacaatattatttccatcaatatcctgaatgatcgaaacatttcgctgccgttttctagactgacaggcattgttgatttgtttacaaacttcaagaagttcaatatagctgattattctcctcttgctctctgcatctgattgacgaaacaattcaatcatataattttcatttgtcaagcaatcaatctgggctgccggttccacagtttcttcatcacaaagcaaatccacaagtgacatatcaagcgctctacatatagacactattttatccgcttgtggattaatttttttctttcgccaatcgctaatcgtactggttgcaattcctgttcttctagacagttccatttgactcatatgtaactcatcaagtctgtcaaaaatcttttcatatatcttcatgccataacacccttctattgattatttccgacttttcggatattgtatcatgattaattatagatatcaacctttatctacattccaccgatatttccaggaaactcctttataatacattttttgttatttatatatattttcaaaaaataagcatccgcccagacgtttttttgtatgttatacttcaaaaagctgccattgcattcctgtcaatccggctgatcatggacaatacgttgccgataacatcctgaccgactggctgtcgtatatccccgcaataccatggattcgcttgaacttgaccgttcaaaaggctctctgcttccacatactgtagtttctgcgaaacaaaatgtgtatttcttttcaccggttcatttccgtgaacgtgagattgggtatcttgttctggaaaactgcgattacctgctggatcatcagtttctttttgagacgctcaacaccttccgtacatctatagaagcgctctatggaaaactgatccttcgaaagaaaaacaaacagctttctcagctttatatccacgattcccttaccggactctacaaccgtatggcttatgaaaagcttgcccttccgctctttcaacaatatatgcagaaaggcagacctgtcggaatcctgttcgcagatgcagatcatctgaaatatatccaacaccgacgaatcccgcatcggaatgttccatgaaatcggacagcaggcagcaactatgcagaggcagccggactggatctggaactgatcctggcttctgtcaattcacgcaataaaaaagccttcctggagaaaactctggataagctttcttcggaagaccttgaattgcttcgtatttatttttcctgcgatatgtccctcaaaaaaaactgcgaagaaacatttctgcataagaataccattcagtacaggctgaaccagattcataaaaaaagcggatacaacccgagagaatttcaggatgctgtgcgattatatctggcattaaaaatgtaaggtcatagatttgcagaagacaaattctaatactaaaaaactccggtcacgaatctcttcatgaccggagttctttatttttacagagtttctattttcactcttacatctgtatttatttcttttttgagatcatatactgtattcgtaatcaccgcttcaccattgtttacaaaaacactgatctggttcaggttcacatatgcctcaatctcgaacccgtctttcagctccggtgtctcaaatttcactctgtgattcgggaatttttcaaaaagggcacttctgtcggtacagattttattcccttctctggaaatcacatatccaccgacatttactttatccccatcctccagagaaaagcgcagacgatatccactttcatctgcctcggatggttcagagatttcctttgtatatactgcctgtacattcggatgaacgcggaaataaatgtgatctttctgcacttccacaacacgcggaatacacatcattccctgccattttccatctaccggttccggcatacggagccatgctgtcagaattcttctgccactctcatccagagtgctctgtggtgcataaaggtctgttccataatcaaggaactggtatttttccggcagtttcatatcacaggtttctttatcaaatgttacctgcatgcatactgtctgtgcatcttctgccttaccatctttaaacaactgcatcggtgaaaagatcactacctggctgttatccacttcaaaataatctgggcattcccacatccagccaaagttttctctggttacagaattttcaaatttccattcttctccatctgtacttgtgaagaacaaaagttttccctgtttatcattgatggtacttccaagtaccatgtaccatctgtccccgtctttccagactttcggatctctggtatggcgtgcatctccgatatctgcatcgtgaataaccggaatcacggtctttttgtctttgatgttgtcaaaatgaataccatcctcagaagtgatcatgagctgtgcagatacaaaatgttcatccacacataaattgatatcctccggattttctgtaagataattcacacctgtataatacagctgcatttttccgtcttcttcaatcgcacttccggaaaaacatccgctccgatcatccgttttgctcggaaacagtgcaattccctgttcttcccagttcaccagatctttgctgacaacatgtccccagtgcatccgtccccagcgcggcccatacgggaagcactggtaaaacagatggtacatgcctttgtaatatataaagccattcgggtcattcatccagtagtctttcggttttacatatattttctgcatattctgcccactttcttatttttctatgaatggattaattacttccatcgctttttctgcttctgcaccttctgcatgaattctcagatctaccgcttttgacagatccacactgaaaattcccatgatcgatttcgcgtcaatcacatatcttccggaaacaatatccacatcacagtccagacgtgtcacagcattgacaaaatcttttactctttctattgttcctaaaaaaatctttacttctctcattatcaacgtcactcctataaataattcatctcagtttctttatcaaagaaatgaatcttggatggcataaatacaaattcaatttcatctccaacctggctgatctcatatttagaaactcgtgcaactgcctggcagcctccgaactggaagtacaggttattctcatttcccatgacttctgtatctgtgatcacagctttcattttattttctttataaagttccaggttctgcgcatccattttaagatcctctccacggataccaagtgtcatctcgccttctttaccattcagtttcttaagaatagcttccggaagcatcagtttatttccgtcttcaaatgttacttcgtttccttttaaggtaacatcaaaaaagttcatctgaggagatcctataaatcctgcaacaaatttgtttaccggatgatcatataattccattggttttccaacctgctggatcacaccctctttcatgataacgatacgatcagccatagtcatggcttcaacctggtcatgtgtaacatagatcgtcgttgcacccatttcacgatgcagcttgctgatctctgttctcatgctgacacgaagttttgcatccagattggacagtggctcatccatcagaaataccttctgatttttcacgattgcacgccccagtgccactcgctgtctctgacctccagaaagattcttcggttttctgtaacggaattcctgcagtcccaggatatcaattgcccagtctacttttttcttgatttggtctgctggcatcttcatgttcttcagcccgtatccgatatttttttctacggtcatatgaggatacagagcatagttctggaataccatcgcaataccacggtctctcggtgctgtctcgttcactcttttgccgtcaatatacagatctccttctgtaatctcttcgaatccggcaatcatacgaagtgttgtggattttccacatccagacggtcctacaaatgcaataaattctttttcttctatattaagattaaaatcatctacagatttgtgttctgctcctgcatatttttttccgatatgtttaaattctataaaactcataattcattaaccctccttggaaccagttgatgttacaccttctacaatctgtttggagaacagtgcataaataataataacagggattgtgatcagtgtgatcactgcaagtgtctgtcccattgttgtattgtcattggatgttatggagttcagaccaatctgcgcggtcagaagatcactggatgtaaatacaagtgacggccagagatagtcattccatactccaaggaatgtaaacacactgacagttgcaacgactgtctttgacattggcaataccatggtaaagaaatattttaccggactgcagaagtcaagctgtgccgcctcataaacatcatccggcagacttacgaaaacctgtcggaacagaaaaatattaaacggattcacgatcattggaagtacatatccaatcacggtattcagtagtcctgcttttgcaatgatcagaaagtgtatcgtgataacggtttctgtcggtacgatcagaagcatcatgatgatcaaaagccactggtcacggaatggaaagttgatctttgcaagtgcatagcctgcaagtccatttacaataaccccaagtacgatcagcagtgccgcatatcccagagtattaagcatgtaacgaaggaaattggtatctgtcagaatcgtaatatagttttcaaaataatttccatttaaagcaggaggaataaatgctgctatggaattcatatctgctgtgattgctgcatctggtttaaaggagtttgcaagcatccagatcaccggaaacaggaagaatatggaaagtaccagcaaaataactgccagtatccagttaattgttttttgcttttttgttaacatgttttttctcctcctttcctttggtcagtacattctgtataattgtcagtatgacaacaaatatagtgaagacaattgccattgttgatgcaagtcccatctcccagttcattgtaccggtttcataaatatcatatacaagtgtgtatgttgagtgatccggtcctccacctgtcatgaccatcggctgtaccagcatacggaacgcaccgattgtaaccgtgataaatacaaacacacaaagtggtttcaattctggaagtgtgatatctttaaatttctgccatgcgcttgcatgatccatctcagctgcttcataaagcgccgggttaatgttctggagtccaccaaggaaaatgatcatctgatatccgacaccctgccatacactcataactgcgatggatggaagtgcctgtttcgcactgtgaataaatggctgtgcactgattcccagatgagcaagcagtgtattcaggattccttccggactgtagatatccatccagagtgtggatacaaccgccagcgacataacaaccggaataaaaaatgccactttgaagtatttcttacaatgtgtgactttgttgatcgcaagtgccagaacaagtgctccgatgcactgacacggtacgataataagtacaaattttaccgtgttaaaaaatgattttacaaataattcgtctttaaaaatgtttatatagttttccaggcctacaaagtgtgtcatatccggattcagtgcaaagtaatcggtaaaactgaacaccagtgtcagcaccatcggcagaaataaaaacaacgtaagaagtaccagtgccgggccaaagaaagccattcctaaaattgattcttttttcttcattattctctcgtataacgttccagtttcgcgttaatcctttctacagatttatccagttctgcctgtgcatctttaccgcccagtccaacactttcaagtgcctgctggaaagatgtacttacctgtggatatacaggagtctttggtcttgggtgtccatatttactcagctgctcgtacagcgctttgtaattttcgtctgtctggaatacatcgatctgttcaaatgctttatatgtagacggaagtgattttgcttcattccagatccttacaccactttccacaccactcatccatttgaccagctctgttgcaccttcaatattgtctgtttctgaagatgctgcaaatgcccaagagcctgtcggtgtatatctttcaccatcccagtcatcaccaactacataaggtgcaacgccaagattcacatccggatagttctcgtagattgtgttgacttcccacgcaccgtcaaatttgaaagctgctcttccactttcaaacagattctcgatcggagcttcggacatgtatttgttctctacgatctggtggaaataattcataacttcaacattcttttctgaattgaaatatccgtccactgtcagtccgtcttcgcttaccaggtctccaccatttgcccagataaatggggcataataataaatacttgattcacctaccgggaatgtcatgtcgatcgggtagcctttcttctcatccatcaatggcttcagttttttcagaatatccataaattcagtctgtgtccatggatgatcggcatctggcacctcaattccggcttcctcaagaatatctttattgtaataaagacctacactggattccattactccaagtgcatacagcttatcatcataagttccctgttcaagaatagattcgagatattcacctctctcatcttctgtcagatctgctaacggctgtatgatgccgttctctgcatatgctgctacattaggtccgtccagagtaagaacatccggaaggccacctgagagcactgatgaatttaccttatctgaatagccgccaccactgtcgtttctaggaataaattcaatatctgcaaaatatttaccattatatttctcattaaagctgtctacagattctctgtacacctgtccttccggagtatcttcaatactatgcacccagattgaaagatattgttctccttcatcatagcctgctacatcgccaggctttacttcttttttctgacatcctgtcaggctgactgccatagccaggccggcaagaagaatcagttttgcttttttcatgttctcctccttttccatctttccgttcttcgtgaccggtaaagtaaccggttactttataaattgataatagcatatcatcatttttgcgtcaagtattctcttacatttcattgatttttacaattttaatatataagttttgtaaaatctgtacagaaccggttactttaccaattctgttactggttaaccttgttctgactctctttttctgttatactaaaattacaattattactgagttttactgaaaggaaactaccatgggcaaaaaaaatataaccttcaatgacattgccaaatatactggtttctcaaaaaccactgtttccagatatttcaacaatcctgattccctcacattgaagaatcagcagattatctcggatgcacttgataaactaaactatcaggagaataaagttgccaggatcctggcaaacgggaaaaccgaatttatcggtgttatcattccaaacctttatttacattactattctgaaatgctaaaccagatactgaaaacttatgatacctatggctacaaatttcttgtttttaccggtgatgatcataaatcaactgaacgcgagtatattcaggaacttctttcttataaaatagaaggaatggttattttaagccataccattccttccagagagctcgcctcctacaatctcccaattgtaacgatcgagcgtgaagatcagtttgtgagcagtgtcaatacggataactatatgggtgcggtgcaggcaaccagtctgcttgcaaagactggagcagatattctgatccatatcaatgttgaattatctccacaggttccatcctatggacgtataaaaggcttttctgatatctgtgaagaatatcagattccacatgaactgattctcacagataccggccacagttatgaagaaagttctctgattctcaaagatttgctggaaacaattgattctaaatatcaaggcaaaacaaagggaatttttcttccaaacgatacatttgccaacatcatgctcaatcatctgattcaaaagtatggacagcttccagatgactacaagatcattggttttgatgattctccagtttccagagaagctattgttccaatcagtactgtcggacagcagattgacaagattgccgcatctgccatggaaatcctgaacgcgcagatcacagaacgccacaaacgaaaagcagttctgtcttctgatccggttcacaagattattcctccaattctgatcaatcgaaaaacaactgagccttctcattgaaatctgatattttttatacataacaaaaacgctgcaaaaaatgaattttaattcacttaatgcagcgttttgtttgccaaacaggcgggcaccgggcaattcccggcattatgcatttctgaaacgacttaaaaattccttcgtcatctcattttgtggatcttcaaagatctgctgtgaagttccctcttctacaataactccattacccataaagattacatgctttgccacatcccgggcaaatgccatctcatgtgtgacaatgatcattgtcagtccgtctttggcaagcgttcgcataacctcaaggacttctccgaccatctgcgggtcgagtgctgaagtaggctcatcaaagagcaggatctccggttccatggcaagcgctctggcaattgctaccctctgcttctgacctccagaaagctgcttcggctttgcattgatatatggagccataccaaccttctcaagatacatcattgcgtttttatgggcttcttccttgctctttttcaggactttctcctgccccaccgtgcagtttttaagaactgccatgttattgaacaggttaaagttctgaaacaccataccaacctttgaacgatattccggcacattcacatgcttatccatgatgttcgttccatggtatcttatctctcctgaggaaggtgtttccagaagattcatgcaacgcagtagcgtggatttaccggaaccggaagggccaatgatacaggtaacatccttcggcttcactgagaaatcgatatctttcagaatctcattatttccaaaagattttcccagatgctgtactttcagaattgtctcactcattctctgctgtccttcctttctttataagagtacattccgctggtatgtgtcagagtatcagcggttgcaagatcataattatccggtccgtccatcttatgttcgatcacacgcaggattctggaacaggtaaatgtcatgataaaatagataaccattgcaattgtgaaggactcaaaatatgtatacagtgctcctgcaacacctttagtcgtgtaaaagagctctactgtaccaatgattgaaagtacacaggtatctttgatattgatgatcaggttatttccgatctgcggcatgatatttcgcagggcctgcggaagtattacatttatcatcgtctgaacatgtgtcatgccgattgccttggcgccttctgtctgtccgggatcgatggaaagaataccacctcgaactgtctctgccatgtatgcccctgtgttgatcgatacaataaagattgctgcaaaccacatagacatattgatgttaaatagataggcacttccaaaataaataaacattgcctgggccatcattggagtcccacgaaagaactccacatagcaggccataataaatttgacaactttgataattacttttttggctgttgaatcatttttgtccaccgggatcgtctgcacgataccaaccaaaaaaccaatgatacatccaaaaagtgttcctaccagcgccagccacatgctgacaccggctcccttcagaaaagaaggaccatattgctgaagaagatatataattcttcctccaaaactctcaggcagcatttcgctcctcctttatgattctgaaagtggctgtacggaaatagcctcatccatcattttattataatcatcttcggtcatatctttaagcacgccattgatcgcatccttaagttcatcgttgcccttctgtacagagataccaatattaatatcttcatcggatacttcaaatgctccgtctgttccactgaagtcaagcagtttgaaatccggatatgctacgcatgcagcctttccggtaggcatatcagtaacaactgcatcacatttgccggattccagggctaccagcattgccggtgcgctttcctgtgccggaaggatatcggcatccggaatctgcggcaggcaggaatcataccagatcgtattctgctgggatgtcactgtagctcctttgaggtcttctacgcttgctgcatccttatagtctccatcttcttttacaagagtaatgattgatgcataataatatggatctgtgaaatcaaccatctgctgacgttcttttgtaatagactgtccggcaataacgcagtcaacctgtccggactgtacagcaggtacaagagaatcccagtcaagctttacgatttcaagatcgtagccaagttcatctgcaattttctttgccatcataacatcatatccatatgcgtaatcggagcttcctgaaatctgcactgcaccgttggaatcatccggctgtgtccagttataaggagcatatccgcattccatggcaactttcagagttttcttatcatccgcactgacactctgaacgcctgcaatgccacaggtcatagatgctgctacagcagccactgtcaacattctccacattttactctttctcattttcgtttcctcctgaaatgtatatatttttttcatccataacaaaaaaagagcgcacggaagtatgaagtgctccgttgcgctttaagtcatattaatactttttcttttaaaagtcaagaaaaaaaagcagctcccgaaggaactgccctgaaatcatatttatgaaggtcttcttacagacaggattgttctgtaagcagcgttgttgctgatcttaataccatctctggagttggatgcatgtacgatctgtccgttacccatgtaaattgcaacatgtccgccatagcagatcaggtctcctggctgtgcatctgcataagaaacttctgttccccagttctgctgctcataagatgttctcggaaggctgtagccaaactgagcatatacactctgtgtaaatccagagcagtcagctccacctgtaagacttgtgccaccccatacatatgggtttccaacaaactgtgtagcataatctacgattgaagatcctgaaccactggatgaagaactgctggagcttgaagagctggatgaagtatctactgtatccggatcaactgtgttgtcactgtcaatcacatttccatattcatcatattctacatcactgcttccactgtcttctgtagttgtttctgttgtagtctggctcggatcaacctcgtttccatcttcgtcatatacagtatctccgttttctgctgcttctgaagcatcaacttcgttaccgtcttcatcatatactgtctgatcttcctgttcctgctgtgcagcttcttcctcggctgctgcagcagctgctgcttcagcttctgcctgacgtcttgcctcttcttcggctgcaatacgttctgcttcaagctgctcaatctctgcctgctgttcctgaatcaggtttgcatattcatttgccatttcctgtgcatatgcaatttcattatcacaatctgcagaatttgctttctttgtatcaatctgattctgaagatctacagactgtgcttcatattcctgtttcataccttccagttcagctttttcctgctgatactgatttccaaggtttgttacctgtgtaattgtgtttgcatatttttcaaggctctgtctgtcataatcatacattttctgagtatactcagcttttgtaagaagatcagaaagattatctgcactcatcatcatctggaaccaggcttcatttccacctttttcgtacagatactgaatacgctgtttcattgctgcgtactgtttgtctttggcattctgtgccttctgcagatcagcctgtgtctgctgaatgtctgcttctttattactgatatccccttccaaggtctgaatggaaaccatgacattcacaagatttgcgtccaaggagttgatctcatcctgtaactgctgcttagcggagtagagctgatcaatctgagcatatgtagcatcaagctgtgcgcttgtagctgcctgttcctctctcagttcgtcttctcttgacgcgcttacactaacaacctgagttgctgtcatcattaatgctaacgtcaggcaaacaattctttttttcatgtttctcacctcataatcattttaactctattttgtaacaattgtgaaatatctttcttaagttcttatacatattaacacaaggttcttttgattgcaagagtaaatcgataaaaagtttaatattttgtaacatttattaaaaactccgcaaaagaaaggagaagttcccgtgtctggaaacttctccgtaacatttcattcttatttaaaatccaaacaattcctgaagaattacatctgcagtcttgttcttaaagttatccggatcagaaagagtggagctgtaccatctcatataatttcctcttcggatgtagttaccgcaggatggacgataggtatacttcttaaatcctgcatatctggacatgtatttatttgcaagagctactgcctggctgtcataatcaccatccggtgtacaggttcctgcaatctggcatcctgcattcggagtggaatgaacgatcacggcactcttatcggaacactgtccaagaacgatccatgtatgaccgtcatcatatccgatgtctcccggatataccttccagcctgtctgggacaagtaattctgatttacataggttccccattttaatgtattcttataataactgccgatttctcctgatacaaccgtataactatttccatttctcataacctgctgtgctgcccatcctacaaatcccgaacagtcaagtccttttgctctgtttgcagtactcagatcacgataattattatagttataactacttgtctggctgagataaaagctctgccatgtcgggctgacaccgatccttgtggaatcataccaaccgccgccccagatatacaatgcctgtccaaccggtttcaatgccccggcaagataattcttgagcgttttaatcccggtctgctcaaccggtttcggatcatttgcaaaataggtattgcttgtcgtactgctgtcatttgcagatgaataggtcataatacctgttgagctgaatgtataggtcacaccatcaatcgacttggtacctgtaaccatcttgaaactactcttgtcaaagtaatatttatttccactgatcgttacccagccgcccgctgcgattcccgtacttggatcaaaataatatgtagcactgccaacctttgtaagtcccttggccataacaccgttgctgccaaagtatcttaattctcctttggcagattttgtccagccggtaaccattcttttgtatttggcattgaaatatctcgtctcatttccggtattcacataaccgctggctgcaattcctgtacttggattgaaataataataatatttgccgatttttttcagtcccatatacatcttaccatcgctggcaaaataccacttctgcccctttgcatttttcagccagccttttgccatcgtataattcgatggctggaaataacggacaactgcgccattggcagatcttacaaatcccctcttcgtgtagccggtcttgatatcgaagtaataatatttaccgccgatctttttcattccggtatacataacaccattttttttattaaaatagcgctttggtcctctggaacttctctgccagcctttcagcaagacgcctgtccttgtattaaggaagtatttctttccatttaaagtaagccatcccttaactttctttccgtttttataatagtatgtttttccttttacggttcgaaaaccagttgtagcagcctgcgcatctaccgtggacgcctgaaacgcaaagcctgcagcaaaaagcatcactcctaaaaatatggctgcgatccatgactttttgcatacctttcccatacggtcaacctctttctacgagtataaatattcgtattttttacaatcttgttacaatattatgtaggtattatatatcatctttgtaacaacgtcaataaaaaagtaaaaacctgccagtatattcccctcctgaagtgcaaaaaggaccggggcaaaaacccgatcctaattttttacaatttcatttcatatattacagaagatgttttctcagttcagcgccatccagtgcacttaaatatgccggtgcaacatcaaatactgttttgcatcctttctgtccttcctggctcatgcgatatgcagctctcgcatatgcaacgattacggaagatgtaaattccggattggaatccagcttcaggctgtattcaatcacatgactgttctcatcgttccagccggttttgcctgtacggatcacaaatccaccatgcggaattccactgtgatcacgtttcagttcttcttcagaaatgaaatgtactgttgtatcatattcatcaaaataattcggcattgtcttaatctcattttcaatgcgtgcaagatcagcaccttcctcagcgactacgaagcattctcttgtatgcttctgtcttgtagtcagttccggattttctccgtttctgactgcttccagtgcagcttctacaggaattgtgtactgttttccatcttttactccatcaattctacggattgcatcggaatgtccctggcttacacccttgccccagaatgtataatcctttccatttgtaaggattgcgtttgcatacattctgttcagggagaacattcccggatcccagccaacagaaatgattcctacatgattgctttcagatgctgctttgtcaacatttgcgaaatgttccggtactctggcatgtgtatcaaaactgtctaccacattgaaccactgtgcatatttcggtgtctgaatcggcagatctgttgcacttccaccgcagagaatcataacatcaattttatctttcatcttttctgcttcatctacatggtaaacagatgctgaatctgtaagaatttttacagttgcaggatcacgacgtgtaaatactgcaaccagttccatgtccggattatgtttaattgcgcattctacgcctcttccaagattaccatatcctaaaataccaatacgaatactcattgtgatttcctcctgttatttcacttcggtagttactgctctgttcacagcagcttcccatatgctgttctttgccgctacatcgctttagcatgacagcacacccattatcataatatcccaatcgacaattgtcaatttttttataaaaaaccttctaaaatattttattgatattccagaaggtctgttatttcttttcattattgacgattcttctcagcaacagaacattccacccgggcagcaaagattacatgccagattggccaggcaaagcttcatacaataatcgcttccgtcacttggcattcctccaaatggattctgttgttcctgataccaggttcctccgccttccagtctctgcagcaacattcggtactgcatattatccggttccatatttactgcacttcgtgcatcatttaacgcatttacattatttcccagtcccatgttcgccattgcggacagataataccactggccgtttctctgctgaagcgacgaaagcacattcattgcctctttgtaatgtcggctgttgatataatttgccgctgcctgtcggcgcactgcctcttcgtcctgatacgtattctggccctgtgtaccaaagcctccaaaaccaccatatgaattatagtttcctgaagaaccatattcccgttctttcatgatctgttcatatgcctgctggacttctttaaatttttcttctgcctgtgctttgttcggattgttgatattggcatccggatgatatttacggctcagcttacgatatgccttctttatttcatcatcagatgcatctctcgaaacacctagcacactgtatggatcaaacatcttctttctcccgctcttccctgcgctttcgcgatatactctcaaatctgcaccatactccggaatataaaatattccgcaggatgtctgcatattttataataggaagtttttcaaattcccgacaggtttctgccatcattagcagcaacatattttttatcctgtcatcaaacccttttattatataatcttttgcaaaagggttgtaatttcctttttttacatcatcttccacatcatcgtaggcatccatcaggtaaataaacttacccaaataaaatcccatgcggcgaagtgttggttcccagacatcttctctgtatgcaaagatttctgccatgattcttccaaaacagcccgaaacacgatcgatatctgtctctccctcctgttccatctctgaaagttcattcaaacaggaaatgatcacatcgatttttttcttccattgctgttcgctttttttctctttactctccagaagcttcccatatgcaagacttaagatttttttctcgtcattccagtcatccttacacttatagtaagtcagaaagatattcatatcggctccgtattctgttatggcatttttccgtaccgtctgtttacgtaccggatgtacaatacatctggtcgtaccttttctggtcggtggctcatacaatgcactgagcagaaggatcacaaatgtcatatcatagctcagtgtgatctgcccgcttatcccgtaacgctctctcagctccctgcacagtccgcagtaaaaagaacggtacatatcaaaatctttaaatttaatttccggcttattcagcaccacatacccaaacatacagatacctctctgtcagtttatcagcttcttttgataaatttcgtatgacatttcggacattcgatttcaatcttgccctttccttttggaatacggatcttctgaccgcatcccggacatgaataaatatgatgtgtctttctctgattcatcatatttttttctcggttaaatctctgtctgaattttgctgttgctgcaagatatttttcattttctgcatatctcttctgaatatctctggacaacattcgatagtatgtatataaaagcaccaaaagccctatcgtgtcaaataatgcaccaattctgtttccacccgggaaaaagatagaaataatgattgctacaagtgcaactcccattgtgaaacgtgcaaatgcgtccactccataacgtccttgcataaatttattaaatttgtctctcatttaagtccttctttctgtctgctcatccgactatttctcatcacatacctggaagatatagaatttcagataataagattcatcagatgcccagagaatcgggtgatccggtgcctgtgttctgtattccacctgacgcagtctcttatgtgcgcttctggcagcctgaccgatcgttttggtaaacagttcatattccataaaatgggaacaggaacaggtcgcaagaaatcctccgtcctttaccagtttcagcccgcgaagattaatttcccggtatcccttgactgcatttttgacagaactgcgtgatttggtaaatgccggtggatccagaatcaccacgtcatatttttctccctcttcttccagtttcgggagcagttcaaatacgtcttcgcaaataaattttactttgtcatccagcccgtttaattttgcattttctgttgcctgatccacagcaagctgcgatgcatccacacctgtaacttctttcgctccggcgattcccgcattcagggcaaaagaacctgtatgtgtgaaacagtccagtactcttgcatctttgcagagtttctggattgcaagacggttgtatttctgatcaaggaaaaatcctgttttctgtccgtctttgatatctacctgatattttacaccattttccacaatttcaaccagtgtaggaaattccggtccgataaagcctttatacagttccattccttcctgtttgcggacctttgcatcacttctttcataaataccgcgaatctggattccgtcttctgccagaacttttttgagcagttccagaatcgtattcttcagacggtcaattcccagtgccagtgactgtacgaccagaacatcttcaaatttgtctacaacaagtcccggcaaaaaatctgcctctccgaagatcaggcggcagctggatgtatctgttactttttttctgtactcccatgcatcgcgcactcgtttctcaagaaattcttcatcaattttctgattttcatctcttgtcagcaatctgactgtaatcttagaattcgtattgataaatcctcttcccagcggatatccgtcaaagtcatgaatcaatacaatatctccatttacaaaactgcccatgatcgttgcaatttcattatcaaatatccacattccgcctgatttcagaagacggccctctccctttttcagtgtaaccactgcaagactcatagtttttctcctttcggatccttctcttttggttttcaaagttatatctgagataaaaaactctttttattttagcacagaaagatatggatttccagcttttcacaatctcttcacagcacagtttcctctaaagggacaaaaaggatgcctccccaaaggagacatcctcatcttgcatcgctgttttttatctttagtaagtttcttctgtagttccatcttcagaatttgcttctgtattttcgtcagttccggcttctgcggtatctgtggaagtatcttccgatgtagtttctccataaaggtttgcaaagaacttcattgtatcatcatacagtttctgtcttacttcagcatctacatttacaagcagatcatcatctgcaatttctgtatcaatactgaagactgtcttcagctctttatccagtacgttcagctcagctgagaagtatttgtctgtgtctgccggtacataagaagcccctgcatcatttaatactttgatataggtttccagaacttttttgctgagtttggaagccacatcctgatcaagtgttaccggaagttctgtcacattctgtacaacgctctgaagtacagcaagatctccctcatattctcccttacagaactgctgtgcctgctcaaattttgctttgccttcttctgtcagtgtttctgtattcagagtatcttctgtagaagcatctgtgttttcgtctgttccttctgtggaaccatctgcattttctgttgttccatctgcagaagtatctgtattttcagtgcttccatcctctgttgctgctgggatttcttcactgctgctgttatctgtactgctgtctgtgctttcctgaggtgtgtcttctgtagttccatctgaacttccatctgtatttacggttccgtcttctgtcgcatccggaattcctgtagaactgtcagaactgtcactgctctcacctgcattgtttgtatctgcacctgtctgctctgcaagtcccggatcctctgtagatgtctctttgacatttccgccaagcgcgccactgtctacattcgttgtaatatcttcaccggtaccttcatcagcaacgttgctctcgatcggagttggtgtaggctgcccttctgcttctgctttgctctgttccagattctgctgaatatttgcaagagtctgtttcatttcctgaatatcataattctgctgtgcgatctgctgaagcagtgatacgatcgtgtcgatctcatcctgacttaagcttacaccattctgctcagcgatattatatacaatattgtagatttcatctgcattctgaatattgtcaccaatgatctgcatctttgcctggttgatgatattggttgcattatcctgtccaacctgctgagccacatcacctgtaactacaacttctttggctgcaaggtctttcttggtagaatccagttcctgtccacttgcagactcgtatgctttcatgacaccggtaagtgcaccagtaccggatacttcatacgggcatgcggcaacaacttcacagttcgttactcctgctgtagaaagtgctgttgcgatcatattacatgttacataattcagattggctgtacgcaccttgatgccgccggactgtgtaggttttacataggcacagctcagtgttctcgttccaatctgttcacttgggatatatttgccaagcagatcatgctcatcctggttggtaacactgataacctgcacctggctcgcatctgccttgaaataattcatcattgtatttttctgttcgtcagtaagatccgctccaagtgtaactacctttgacgcatctgccattgcaggaatcggtgtgctgactgccagacacatactgcagagcattgcaacgataacgcttcttttcttcatatcttcatcctccattgttcacgccgacagaaaatccgagtatcttccgaccggcaattacatcttctttttaatatccagtattataacatacattctgccataattgtattttttattttctgataccagacagaatcatgggcatgtacagcacgaaacaattttcagatatcatattacttccataaatacctggatcgtaccgccacatacgagtccttcctcttctgcctgtgaagcagtcatatctactgtaaaaatctgcccctgtgcacccttttcatgaagcattcgcaaacagagatgctgtacttcactttccatgcatccgcctccgatcgttcctatgattcttccatcttcaaggaccagcatctttgttccaatgcctctgggtgctgaacctcttcttgcaacgatcgtcgcaagtgccttctttgtgtccggctccttctcaccagtcagatagtccagcagttctgcgtcataaccactcgtcttacgcacactgtttttctctttgatcagttctgaaacaatggagactgcaatttcctccggtgtttctgcatggatatcaagtcctaccggtgtatgtatctcatccagaacctttctgtcaaaaccatcttcctccatctgttttttcagaagagccgatcttcctctgcttgccatcattccgacataagcatagggtttcttcaaaattgcctccagacatacccgatcataacgatgccctctagtcactaccagaaaatacgtatcttcacttcccagaatctgcttcagtgcattttcaaaactgtcacagattacccgatccgctcctgcgcgtagtgcttctcctgcaaaactcacacggtcctccagaacagtcaccgtaaatccaacttttcctgccagaaggatcacctgctgtgccacatgtcccgctccacagatcaccagatgtgccggctgtttcagtgattccacaaataatcttctcccatctgcttctgcaataccactctcccccggctgcaccagttcctgcagccgttctatctctatgtctccgctgccgcattgtgctttcacttctccgtccgccaggaaatatctgcttccagtcccatttccctgtatcacggtcaccagaaaattatttcttcccttctgtccgtctttcagtacattatataattcaaaaagattcatcttatccctcctgcgaatcttcggctgttttattcgctccaaagtatagcatgtcacaggacagttgtatagcaattctctgtaaataaaagaagacataccgatgtttccacatatggactacatctgtacgtcttacttttacaaaacgtttatcttcggcatatttatcttttataatgccttgtaatacagcgcaacaatatcctgttttcgcgaagaacgtgggtttacagcaatatttccactcttcatggcatcatctaccatcgcatcgattttactttcaatctcatcctctgatacttcttttcctttggccgcctgacggatagctgttgtcagatctgccggaattccgatatcttcattcagttcacgtattgcgtcaaccagcatcaatggctcgaactcatcttcaaatgccggaatcggactgatgtaattatagattgtcagatatcttccatggtctgccagggcattatattcagcaatcaccgggagcagcactgcatttgccactccatgtgctacatcaaaaaatgcactcaccggatgactcatcgcatgcacatttccaagtcttgcaaaagaaaaggcaattcctgcaaaaagtgaccctgtcagcatggcctctgctgcttccaaatctgtacgtcttgcaacaaatctgcgaatattttttccaatcagttccatggctttttctgccatggcatcggagaatggtgatgcagcggtagaaacatatgcctcttccgcatggataaatgcatcaattccacatgccgctgccacagaagccggtgcagatgtcagaagctccggatcaaggattgcatatgatggaagaagttcataactgaatactgtcagtttataatccctgctatgatccgtaacaacagaaaatgcagtcacctctgatccggtacctgcggtagtcgggatcgcgatcagcggaatgatcttgcccggtactttatgtgccccttcatactctgtgatactgccgccaaattttgctgtcacaccaactgctttggcaacatccatcggagatcctccaccaagtgccacgataaaatctgctccagcttctttaaatgcctctgtagccttttcaacagtcgtcacggacgggttggcctctacatccgtaaagatatccactttcataccagcttctttcagataatcagccgctttgtccacaattcccatttttcgcagtgtagggccggaaatcagcatggcatgggaaccacccagtttttttgcacattccggaagttttgccatcgttcctgcacctaccataatattctgtggaataaaaaattcaaatgcttccataactaatcagcctcttttcttctatataactatatcatatcattcaaaactccatatttccgatcttatgccgtcattctggaaagtacacggtcaattgccgcatcaataaccagatccagttctttatcatcagcctccggcataagagatgctgcatcttcatccgaaatgatctcaataaggctgccgaatttttctttgtatttcactttgcagactgcataaaatacaacgccaaggagactccatgcacctaccatcatccattcctgcatgatcagtgttccgccggaacccgggatacaatacaccagaaccatacagccggaaaggatcactgccattgtacctacaaatttgtaagccggtacacgataaggtcttggcatatccggttcctttttgcgaaggatcaggaaagagagtgaaaccatacaatatgcaagacagcagccaaagttacctgcatcgcagatccataccatcatgacacgtcctgcgaaaggagcgatcatcgtaaggataccgatcaggatcagtgcattgaccggtgttttgtgctttggatggagttttgcaaatactttcggaaccatgtaagattctgccatagaatacaatgcacgggaaccaccgatcataaaggagttccaggatgtaacaataccgcacataccacctacgatgataacctttgccatcaccgaggttccaaaggcttttgccatcgcatctgcagttaccagtcctgttgtactctgcgaaagtgcaatctcttccggattcagaacataaccaactgcgaggattacaaaagaataaaatacaactgcaagtacaactgacagaatcatcattttaccaatctttttgagtggtacattgatttcctctgctgcctgcgggataacgtcaaaaccaataaagaaaaatggtgtgataactgcgactttcagtacattttttgccatggtaccagttgtctcacccataaacatctgtccctgaagattatccacattaccatttataacagaagctacgatcagaagaattcctgcaccaccgattatacatgtaagaactgtctgaagaacagcagctgtttttgctcccataatgttgatcaccatgattaagaaggccacaagaattgcaacgatcagccaggaagcatagatatcaaatccggcaactgtataaagatagcctttcagaaatcccggccacagataggtgatgatcgttggaaacgcacaggcttcaaaacaggtaactcctacatatccaagaatgatcgcccaggtacagataaaggaaccggtaggtcccattgccttatagctgaatacgtgctcaccaccacactgtggcatggctgcggtaagttctgcataggtaagaccaacaaagaagatcatgacaccaccgattgcaaaggcaagtgctgctccgacaacaccaccggcatcgatccatgttccggaagatacaacccagccccagccgatcattgcgccaaaagcgattacaagaatgtcccatgcactgaatactttatcaaattctgattttttctgtcccatagtcttattcctcctcgcttccaaattttcttctgatcagttcttccaggtattctgcagttccttctattccaagatatgagctgttcataagaatatcccggttatgacggtcgcctcggttgctgcctgtcagcgccagatgacgtttatggtatcttttatctttttcccgtaataagatctttgcatctttttcagaaaggttgtgactctccataatattatggatacgtacctcatccggagcataaataaatgctcttaaaagatcaatatcttttgtatccttcaggatataatctgcggaacggccaatgatcacgcaggattctttctctgcaagttttcgtatgatctgcttctgcacatggatcgcacggtcagtcagatccgcatacttggaaaacgagccacgtacatcgccttctgcacctttaccggcaatcgttccgccctcctctactttttccatgatctctttcggaattccgacctcttcaatgatctcatcgacaagatcacgattgtaaaatttgatattgaggtcttccgctatttttctgccaatggcatttcctttggctccatattcacagccaatcgttataaccagatgtctcatatcgatttcctctcacacgaatttttgttaccgttttttcttaattacacttttattctgtaacaaaaaaggcgtgcgaaccataccctgatgatccgcgacgcccttgtcaattttgtctgtatttatttttccagagatttgatcgtatcttcaatgatagcaactgctttatcgcactcttcttctgttacgataagcggtgggatcatacggataatgtgtgctccgatcgcagtgatcagaagctttcgatccagacagccatgtttcacatctaccccgccaatggtatcatcaaattccacacctaccagaaggccctgatgtcttacttcttttacatgcggaagtttttccagtttggatgcgaagtaatcgccgactttctttgcatttcctgcaagatctctgtcaagaagttcattcacttctgcaagtgctgctgcacagcttaccggatgtccaccaaaggttgttccgtgagaacctgcggtaaatgctttggcaacttctgctgttgcacagattgcaccgatcggcattccgccgccaagtgctttagccatggaaacaatatccggtttgatgccataattcatataagacattacagcacctgttctgcaccatcctgtctgtacttcatcgatcagaaggagcatatcgttttcatcacagaatttacgaagtccctgcataaattccattgttgcaggatgtacaccaccttcgccctgtaccggttcgaccatgatcgcgatcgtattttcggtacatgcatctttgaatgcctccagatcgttgtacggtgcataggagaatccataagtcattggtccgaatccaacctgacatccgttagccggctgacctgttgctgacatggcaccgaaagttcttccatggaatcccatctttgcagttacgatatgataacggttcggtccgtatttttcaataccatatttacgtgccattttgatcattgcttcgtttgcttctgtaccggagttctgatagaagatcttgtccattccgatcgtttcacagactttttcagcaagcagtgcctgtggaatggtatatggatagttaaaggtatgcatgatgtcttctacctgatctttgacagcagctacaactttcgggttacagtttcctgcactgtttactgcaataccagcataaaaatcaagatatggtgttccgttttcatcgtatatatacatgccgtctgctgtctcagcaagaaaatcaaaacgttcataagtctcgatcatgtacttgtttactttgtctttgatgtcctgaaaagttaatcctgtgtcttttaatttcattgctgtgtcctcccatatctttaagataataaaaaaagcaaaggcagatttccgttaccggtaagcgcctttgctttgtttttctgtgtattattttgtacaacattacaatatcactgacactattatttgtcaatagattttttaccaaaaagatttttgttgattttaaaagactttttgtattttagagatatattatgcaattttcttttgtgcattatattgtacattttgtttctgtatgttattacattttgtttgttctgccattccactttcttatcactgttttccgtgataatcaaggaaaaagcaggtacagcaggccttttccccaccctcattccggtatatatgatcctggtctgtctcaaatttgaacacctgatcttttcgaatctgacagctctgtccatgacattctacagtcagcacaccttccgtcacaaccagatactcgcgcgtcttctcaccatgacttccactcacataaataccgccgggctcaacttcgatccgatacacttctataaggcgtgtatcttcatacggcaggcaggtccagacacggtactgtccttccagttccttggtcggaagcagttcttccggtgtcacgagacagcagtctactctcggcggctggatcagttcctggaattcgactcgaagaccgctggtgatctttccaagcactccaagcgatggattagccgttcctctttcaatctgcgccagcatgcttttgctgacaccggtctgttccgctgcctgatccaggctcatacattttgattttcgaattcttttcagatttgccgcaacattttttgataaataatccataatttatatcttttctttctctgtaagcattgatgctttccactcagttacgcttaagtgccattttatttcagaaattcatcgacatctattcctctgaatgaccggatcgtcgggaaatatctgtgttccggcggttctttttcctgggtataccagattcctttcagtccgctttcccaagcaccttcaatatccttttttacgttatcaccgataaatgcacattcttccgggcgaactcccgccttttccacacagatatcaaaaaaatgataatgtggtttctctacccccgcttcttcgctggtaacaataaaatcaatatatgatgtcacaccaattgcttccagttttctgtactgaacgtatgcagtcatgtctgtcccgattccgatacggatttttctttttttcagctctttcataaattccaggattcccggatttgactgtatatgctgaataaatgtgtcccagtaggcatgatacatatttcgcgcatgcggaaaaagtggctgttcgagaagttccagcatacactgcatccgcaacatacggctgtggattgcagcagtatctgttccgatccggtctgtcatgattcgtccggcctttctgtagcaggcctgcatatcgtctgttgtaatcccaaacgaatccctgcagtatacagccaaagcttccattccataaatatgattttcatcataactgtataaggtattgtctatgtcaaaaatgaccgcttttatcatcatgtttctccttgtcttttttcctgatttctatcttaccctattcttttccttttgaccatataaaaatgccggtgcacatctgtttctttcagatatacaccgacttcttcttactctaaaatatgctctcttcccatggaaatgatcgttcttacgtgatcatcggccagagaataaaaaatagattttccgtctctgcgggccttcaccagtttattctgcttgaggatacgaagctgatgggacactgcggactgggtcatgttcaggacctttgccagatcacagacacacacttcagattcaaacagcacaaacaggatacggatacgggtagaatccgcaaacaccttaaacagatctgccagatcatacagttcttcttcgtccggcatagtctcattcacgatctttaaaagatcctcatgaatctcctggcaatcacagatgatttcttctctctcttctgccatatttttctcgctttctctctaaattattcagttcaggtaactacaattttttaacaaacaaagttctgatcgcattcagcactgcaatgatcataactccgacatctgcaaaaatcgcaacccacatattggcaatacccactgcaccaagaatcagacagattaccttgattccgattgcaaaataaatattttcatatacaatacgcatacatttctttgcgatgcggatagctttcacgatcttcatcggatcgtcatccatcagaactacatcagcagcctcaatcgctgcgtcagaacccatagctcccattgcgataccgatatctgctctggaaagtaccggagcatcattgataccatccccaacaaaggcaagtttctctttctctgtcttttttgcgagaagttcttctaccttacttactttatcagccggaagaagttcactgtatacacggtctacaccaagctcacctgctacctgctgtgcaaccttatcaatatcgcccgtcagcatgaccgtctctttaatgccatttttcttaagatttacaattgcctcttttgaagtcggttttaggacatccgaaatcaggatatgccctgcataagctccattgattgcaacatggatgaccgttccgacctgatggcactctactgcctccacgccgatacgtttcatcagttttgtatttccgactgcaacagagattccgtccaccttcgccgtaacaccatttccgctgatttcctctacatctgtgacacgtttctggtcaatttccttaccgtaagcagttttcaggctgcggctgatcggatgtgacgaaaaactttctgccagtgctgcatattccagaatctttttttcttccatcgtgttatggtgaacacctacaacttcaaacacacccttggtcagggtaccggtcttgtcaaatactacatattttgtctgggccagagtttccagataattggatcctttgaccagaacaccggcattgctggctccaccgattcccgcaaagaaccccagcggaatactgatgactagagcacacgggcagctgattacaaggaatgtcagggctctgtagatccactggccccacattgcaggattgtgaaggagcacgagatttacaagcggcggcaggattgccagtgcaagtgctccataacatactgccggtgtataataatgggcaaattttgaaataaaattctcagatctggatttacgggaactggattcttcaatcagttccagaatcttcgatacggtcgattcgtcaaattcttttgttgtcttaatcttcagtacaccggtcatattgatgcatccgctgatgatctcatctcccgcttttgcactgcgcggaaggctctcaccggtcagtgcactggtgttgaggctactgtttccttctacgatcacgccatcgatcgggactttttcacccggctgtacgacgataacggaaccaacctcaacttcatccggatctactttttctaacttaccatcgttttcaatgttagcataatccgggcggatatccatcagttcggtaatgttacggcgactctttccaactgcatagctctggaaaagttcaccgatctggtagaacagcataaccgcgatcgattcgttataatcgccgcttttttcataaactgccagcgcaaatgcaccgatcgttgcaatggccatcaaaaagttttcatcgaaaacctgaccatttttgattcctttaaatgctttctttacaatatcatatccgataaccagataaactgccagatagcagataaatctcggaattcccgtaatcggaacgaaatgcaaaacgatcagtaacaccgctgctatgatgatacgtgccagcatttttttctgctttttattcataacctctttcctcccgccatttatttaaatgccctgccgcatccgcagcagagcattctcatttcatcttataaataaatctcgcaatcgtcttctactttcttacagttcttcagaacttctttcattacgctgtccggatcctgtccttcttcaaattctactttcatcttgagcatcatgaaattcacgcttgcatctttaacacctgctgtgttcttagctgcttcttccattttatttgcacagtttgcacagtcaacttcaattttgtaagatttcttcatagtagtattctccttctcatatatgttttattcacgttttcatatgaacattcattcatatgtttgattgtattataacactacccccatatatgtcaatatattttaaagaacttttcagatgatttatgcacaaaaaaaatcctctcagtattgtaaaaatatactgaaaggatttactctcttttattccttcaccagcagtgccactgcttctgtccacacggtctcgcagaactggtctacacaacaggctttttcaagtcgatatcccgcctgcaaaaatgcctccagatcacgtgcaaggctggttgctttacaggagacatacacaatacggtttaccccataggaaagaatcttcggcagcgctttcggatggattccatcgcgaggtggatccaggacgatcacatccggcttctcagtcagatcatccagaaccttcaggacgtcaccggcaatgaatttacagttatccagtccgttcagcttcgcattctctcttgctgctgcaactgcatcttccacgatttccacaccgatcacttcttttgctaccggagcaagcagctgcgcgatcgttccggttccactgtaaagatcgaacacttccattccactcgtattctggatataatcacgcacaatattgtacagtacttccgcagccagtgaattcggctggaagaaagaaaacgtgctgatacggaatttcagtccgagcagtgtctcatagaaatagtcctgtccataaagtatccttgtctcatcgctctgaactacatctgaaagtgaatcattgagaatatgcatgattccaacaatcctgccctccagtggaagagccagaagctgatctttcagcggttccagatcatactcttcctgagtggttgttacaagatgcaccagaatctcaccggaagtaacacctcttctcaacatcaggtgccgcagataaccggtgtgctgcagtttcctgtaataagaagctcctttttctctgaaaaattctcttacacaagtcaggatatccgtcatatccttatgcaccagcttacagtcgtcagtattcaggatatcatacgtacttcctttcttatgcaggccaagggacagtggtccgtctttgacctcatctccaaaagaaaactccatcttattgcggtatccgaattcgatcgggcttccgtgaataccctcccattcaaaagctgcatttccattctcatctatctgaccaccctggatcaatgcctcttccagaagctctcgtatctgtgtctctttcatatgaagctggtcttcataggacattgtctgatacatgcagccaccacatgctggaaaattgctgcataccggttctcttgtctccaatggtgatttttctattacctccaggatacgtccctgtgcccttccggaacgtttcttctgaatcataaagcgtaccttctgtcccggaattccgttcttgatcagaaccttctgatcctccacaaaaacatatcccttattcgggaagtccaccttctctattacaccttcgtaaatttcaccttttttcatgctttctattcctcatttatatatttgaaacacttgcatccagctgtctcttcgtaaccctcactcttttgtctttgacagagcagtaaaacagccccggttatctgccggagctgtttgaacttcatgctacgcttactctgttgccattctctctgcaagcagtcatcttactcttcttcatcctcgaagtaatcatcaaaatcatcatcgaaatcttcttcaaaatcttccagataatccggagcaaagaagcgatatactgcaaatgcgattcctgcaactgctgcaactgcgcctatgatagccagtacccagaggactgtatttttttctttttcgtcttcttttttctttaaagcagcaagtaaatcctcaattttctcgttcaggtttaaattattcagattcatgacgggcaccttcctctcactcatttataggtcatagtataccactaatccatccattttaccatattttctcgcaaattttcgattatgtttctgcaccttatccatccagaacttctgatacaccaatccgctccccaagttttactcttgtctcaattcccttttcggaattcataaagatgtctggatcaggcagtacccgttccttctgtgtcatcagtataaccgtcgaaccaccaaatgcgaaatttcctttttcttttccccgttttacacggccacgaagtggtacattctcaatcctgccgaccatcaacgctccgacttccatcatcagaacagttccaaaattcacagtcttcaacaacgcatattctcttgtattttctttgtagattggatacacatcattggcgaccggattgaccgtatgcagttcacccggaatatgcactctccgggattcaaatccatcatctatatagatatatctgtgataatcgtccacacataaacggaacacccagagaagtccgccttcgtatcgtttcgccagaaccggattcttcagaagttcagcaactgtataggatgtatgtttgatttttacatgacagttctcactgatcggataaacactcaccctgctgtcgcagggactgacaaaagcttccggtaccatatcaatttctctggcaccctctcgaatctgtctggtaaaaaaatcattgtacgaccaatactttttcggttcataatctctcatatcaattcctgcatgtcttataaatgccggaaccgccagtgcagatactctggagtccagaattctgcccccaatctctgaaagtacaggatttacaagaggtttaagtaaagccctgccaatcgcagagccatacattttttccaggaatctgtcctgaaacgaatcattttcagttacatgaccttttcggtctgccgtatatgttgtcatgctgctgctcctttcaacttcctgaccgtatgataatgagcccaccatccttctttgtaaaaaagaataaacaataccgccactgccacaactgcaaccaataccaccagttcctgattggtcggcttacggaaacggaaattaaaaataaacaagaatcctacgatcagcatcgctacatgaagcaatcccacaaaataacgaaatcccgggaaaaataccgatgccacaaacagaaatggcatgatcacagccatagatgtgattggaagtccctgatagtacttgcggttctcagatgtctcgctctggcgttttgcctccatcacattaaagtatgcaagacggatcactcctgccatcccgtaaaatgcaaggatcgcaatgctgtatgctttacacattccaagtttgtagcccagaatgattggaaaaatcccaaaacagacaatgtcacagagagaatcgatctgaatgccaaaggatttctcatcatcggtccggttcttctttgtccgggctatctttccatcaaacatatcacacagtccggaaaaagccagacaggatactgccagagtaagcctcccgtcgatcgcacaaaacatacccaggatggatgaaacaagactgatatatgtaacaactaccgtataatcgtaaaatcctatcattcgtaactctccttattttctttgccatgcccctgcccgatcgtaagctgtgccacaatcgtaaaaagtgcactgatcaaaagctccccataataaccaagtcctctgctgagaaccatccccggcagaagtaatgtgccaaataccggggtgaatattgtcaggaacagtgtctcactgattcccatacctcccggaagtggaagcatatctacggaaacagagatcactgcctgaagaaacagcaccgtccagaatcctgtccctgacagtgaaaatgctttatatacaaaccatgttactgcaaacattgccattctctgtacaaatgtgatcgcaatgatattcacgatcactctcggatgtgtcttcagataagcagctgtatctctgtaagtatccatggaatcttccagttttttcagccttccttctttgtgacgaagaatacggaatttctcaagaatcgaaagtccccatacaagaaatgatctggcaagcagtggatgaaataccagaatcgtcataaaagtcacacagaaaatattcagtcccaatcccagatagaaaacaggaagaattccttccagatactgatgcaggaatcctcttccaaacacagccactccgataccgaccaccaccagcaccagcttataggtgatcgtaatgatcatcagaataaccgcagaaactggaatagatatgtttttctttttcatataatatgcctgcattggctgtccaccactcgcagatggtgtaatacagctgaaaaagaatcctaccgatgaaaagagaaaacaggttcttttttttagttttattccataggaccgcatcatataccatatgatgatcgactcaccccagataaagaatgccaccagtgcaagcccgggcacaagccatcgtttatccgcactccgaatggcatccatcatagctccgagatcttctccatgaaacactccataaattgtgagcacaaagacaatgatcaggaaagctccattaaagatcactcttttattttttttcataagcagctcacccttctgtagatttcagaatctttttctcgatcctgctgccaaatctttcgtaaattttgtacagatttgtgtttcttccgatacagaaacacagttctgcaagaaggattcctcctgccacgtccaccagaacatgctgtttcgtcagcaatgtagagacaaacacaagaattgccagcactgccgaccctctctggtaccataccggaatttcttttcttccgcggatgcccaaatagcagaaccagctgaccagacaatgaatagacggaaacagattatctgctgcatcaatagagtacagccacaaagcaagctgattccataatcctccatctgttatcactggtctagtattcgttgtgggatacaaaagaaagaaaccaaggcagatacatcttgatataaaatctcctgtaaaaaactggtacacactgtatcgatcctgcctggcaatcagaatgtaattgacggcccagaaaagatagcatccaaaatagatgatcagaaactgtgggacaaaaggaaggctcctgtccacagcagtttctatattgtggtggtaccatccacctgcgatcattctggaacctgaataaacaagacaattaaatacaaacgaaaaaataaccgggaaaattccatatgcagggagtatcctcgtgaggccttttaaaatttttttcattctgtactcccttcgaattttcatgtatccagtatatcattcattaaaaggtaaaacaactaaagtacagaaactttaagatttcttaagaaaattataaaaagttatatttttttaagttttgcaaaggcagcgaacatttttttgactccgactttgtcaaaatctacagtaacctcataatctctgccgccttctacgatatccttaacgatgccaacaccaaatttaatgtgacggaccgtatccccaacaccgtaatccagggaatccgctttcgttaccttaaaattctgcggctgaaatgccttcgtatggaaacttttcttcatctgcagatagctgttgagcggagattttgtctccgggatctttggtttgtgttcctgaacagtatgtccaagatccaccagttcccgtggaatctctctcacaaatctggaaacgcgattatactgtgtttccccacgcaccatacgctgctgcgcactggtcatagtcagttctttcatggctctggtgattcccacataacaaagcctgcgctcctcttccagctccgactggtcaccggaaaagatgcacatactgctcgggaacatgccatcttccattccggcaaggtatacatatggaaattccagtccctttgcactgtgcaaagtcatcagtaccacataatcctgattctcatctacagaatcaatatccgcgatcagcgcaatttcttccaggaatccggataatgttgcttctctgttctcagccttcattgtctcttcataagaaaccgttttggatatcagctcatcgatattctccactctggctctggattcttctgtatcttctgctttcagttcatccacataaccggtcagatctatgatttcctccagaagctccgatacagaatatgcctgtgctttgctcttaagtgactggataaatgtaacaaatccatccacttttgaaagactgcgtccgatcgacggcacttcctctgccacacggagtgcatcataaaaactgatattcatcatgtcggcataatcctggattctgccgaccgttgttgctccgattccacgctttggtacattcaggattctacgtaccgcaagatcatccgctgcattgtctaccgttttcagatagcagagcagatctttgatttctttacgtgcatagaagttcactccccctacgatcttgtaaggaatgtttgcaagcagacacttctcttcaaaaagacgggactgcgcatttgttcgataaagtactgcacaattatgatactctgccgttccttctctgtgtcgtcgggcaatgtcccctacaacaaattcggcttcctcatatccattcataaactgtcggaaatgaattttctcaccctccgggttctctgtccagagtgttttttctttacgctctgtattatttgcgatcacaccattcgctgcatttaagatattctgcgtagaacgataattctgctccagacgaataactttagcatccgggaataccctctcaaatcccaggatatttccaatattggctccacggaatctgtaaatggactggtcatcatcaccgactacacacagattctcatacctagatgccagaagacttacaaatttaaactgtgccgtattggtatcctgatattcatctaccataatatagcggaaacgttcctgataactctgcagaacatcgccacaattctggaacaattccactgtcttgcatatgaggtcatcaaaatccagtgcattattccgacgcagtgctgcctgatattcacgataaacctgcgccgctcttttctggttaaaatcagcgcctgcattcatttccatttcatccggagtcagcagctcatcttttgcatgtgagatctgagccagtagtgcacgttccttcactttcttggtgtcaatattcattttgcggcagatttctttgatcagtgtcttctggtcgtccgcatcgtaaatcgtaaaattattatcataaccgagacggtctatatggcgtcgtaagatccgcacacatgtcgagtgaaaagttgatacccatacacttcccccttcgcttcctgcgatcttgtccacacgttctctcatctcgtgggccgctttgttggtaaatgtgattgccagaatattccacggattcacacccttttctgcgatcagataagcaatcctgtgtgtcagtactctggtctttcctgagccggctcctgcaagaatcagaagtggtccatctgtatacagaacagcttctttctgtcggtcattcaatgtatcataaattgtattcatcaattatctcctgtttctttgtggttacatatttcgaactgatgttttcttgctatctttttaattatacatgaaacctggtatggggtaaaggaattttaaaatcatttgcaaaaaccatttacaagtagtatttaaaactatataatagagcgtgcaggtattagaaataccattctgcctttatttcaggcaaaggagatgaatttatgtcagttaatacagactccatgatccgtaatattctggatcgtgtttccagaatcggttatgtaaaaccagaggatattcccaatatagatctttatatggatcaggtcactacttttatggaagcacagcttgctcattccaaacgctatgaagatgacaagattcttacaaagaccatgatcaataattatgccaagaataatctgcttccttctcctgagaagaagcgctattcaaaagaacacctgctggttctgatctttatctactatttcaaaaatattttatcgatcagcgatatccagactctgctcggaccactgaccgataaatatttcaaatctatggatgatatggatctcactgctatctacaacgaagtattcagtatggaaaaaggacagattgaatctcttcagaaggagcttctggaacgctatgaaattgctgagggaacttttgagaatgcaccggaagaagacagggatttcctgaaattattttctttcatctgtcttctcagctttgatgtttacgtaaaaaaaatgctgatcgagcagatgatcgacgaactccgtgcttccacggatacagacacaaaacataagaaaaaataatacagcatcagaagtactgatcctgtattacgtaaaaattacctgcatcactgcaggtaatttttatttacatagccgctctttccaagtctggaagaatatacataccagtaagtacttccactggaatcctggacctgaacggtatcgccgttattcaactgtccgatctcatttgcatcatcatacgcttttgcattacgaagtgccagatagccactcttgactttcactgtctttgtaacaaccgcagatgctgtattgtctttattttttaccagataatctttgtttacatatccgccctttccaagtcccggtacatataccagccagtaggtgctgtcactggaatccgcaatctgtaccttatctcctgtataaagttccgcaacttcattggacgatttaaacgccttggcattacgaagcgccagatatccactcttgacacttacataacgttcacttgaagaattcgccagatatctgcgatttacatatccggatttcttgagtcgtgatgcatatacataccagtaggtgcttccactggaatctgtcacatcaacggtatcacctgtataaagcttaccgatctcattcttgtcatcataagcctttgcattacgaagtgccagatagccatccgctactgtaactgtgtaggaagtggtggccgcccatcctgtctgcaccgtcatcggcatagcaagtgcaagtgcgattacacatgtgaaaatacgtttcaggactcctgacctctgcattgtggaaaatctcttcttcataatgttgccctcctttgtatttagtttttgctccccgtgacaagtcttcgagcagatacgacaccgaaccgttcttgtcaaattttttattatagtttatcatataggaaacaactttctgtaaaataaaatttctcgggaggatatatattcatgcgcaaactattatctgtttttcttgccggatgtctgcttttactgcttcctgccacaatctgggcttctgcggaaaccacctatgaaagcgaacagggacaggccatgatcaaggctccatcttcggcttctccaaatgcttctgccaatactgaagccgatgttgattcttcagatgactccgaaggtactttgagtccttctggttcttcctcaggcatggactggtctgccgcaaacacggcttcaactccgtcttccggttccagacagtttaccgtctgtattgatccgggacatcaaggaagctgggtagacatgagtgcacaggaacctatggctccaggctcatctcagaccaaaaataaagctacgaccggtactgccggtaactactccaaggttccggaatatgaagtcaaccttgaagtttctcttgtccttgaaaaagaactgacttctcgtgggtacaaggttgtcatgacccgcgaggataacgacaaggccatcagcaacaaagaacgtgcagaattcgccacagaatccggcgccgatatcacggtccgcattcatgcaaacagtgacaacagtgcttctgctgccggtgctcttaccatggcacccaccagttccaatcagtatctggacaagaaaatcatcgaaaaaagtaatacgcttgcatcctatatcatcgacagttactgcaatgccaccggccttgcaaacaaaggcgtcatctctgccgacaatatgactggtaccaactggagtacagttccggttgccatcctcgaaatggggtttatgagtaaccagaatgatgatctttacattaccaattccgcaaatcacgaaactatggcaaagggaattgctgatggaatcgatgcatatttcaatactgtcgaaccagatattactactgtcggagaacatctcgccgatctcacctcacagctggaaaagaactatacggatccgcttgaacaacagggagaactctgggcaatcgcagctatggatctgaagacgcaggcctacagcacagtcaatgccgaacagtccatgcagtctgccagtgttatcaaagcatttatcatggccgctgtttatgacaaactgatatatccagatgaaggaactacggtttcatccgattatgaaagtactctgaaacctctcctcaccagtatgatcacagtcagtgacaatgactctgccaacgaactggtccgcaagctcggtggaggcgattttcagacaggagctgctattgtcaatgagttctgtcaggagcggaactacacctccacgcatcttggccgcgagttcctggcttctgatccaactgatgacaattacacaagtgcttccgactgctgccgactgctctctgatatttacaacagttctctggtaaacgcagaaacatctgccgaaatgcttgcgctccttacgagccagacaaagacagccaagattccggcaggtgttccttccggcaccgcaactgccaacaaaaccggagaacttgcagactccggaaaactcggtgttgtcgaaaacgatattgccattgtctttgacaaagagcatccatatgtgctctgtgtactctccaataatatcaagaataattccagtgcacagaatacgatcaaaaaaatctctgcggatgtgtatacatatatgaccacaaaacaaaagtaatttctcacagcaacaaaaaaggaacagacctttggattattccattgcctgttccttttccctgtatttctttattctttattcttctgtctttcctgcggtttctttttctttcattctggaaaagaccatctcatatccgtcatttccgtagttgagagaacggttcacacggctgatcgtagctgtagacgcacctgttttttcggaaatatccagatatgtgcgtttgtctgtcagcatcttcgcaacttcaaaacgctgtgacagagaaagaagttcattgatcgtacatacgtcttcaaaaaacgtatagcactcttccttattcttcagacaaaggattgcttcaaatagatggtcaacctcttctgttctgatttttttacccataaccttgctcctttagttacattcattatatgttctgtttcatatacatggtattttaacactttaacatgtgaaaagcaagtgctaatttagtgcattaccagtgatcaacatgtcacattatctttcatttttcctttatttattcctgtttacagcaacttgaattttgttctcatatcaagtatacttagaacaaatgtacgtactgaaaaggcaacgtattcaagaatgccatttttcagtacatatccaactgatcatagaatggagcatctgctatggatttatttgaatatgcaaaatcaaaaacacttgcccgcgaatctccactggcttcccggcttcgtccgactacgctggatgaagtcgttgggcaggagcacatcgttggcaaagataaattactgtaccgtgcgatcaaagctgacaagctgacttctgttattttctatggacctcccggaaccggaaagactacccttgccaaggtaatcgcaaatactaccagtgcaagttttacccagatcaatgcgacagtcgccggtaagaaagacatggaagaagtcgtaaaagaggcacaggaccgtcttggcatgtatggcaaaaaaacgattcttttcattgatgagattcaccgtttcaacaaaggccagcaggattacctgcttccatttgttgaggacggtacgatcattctgatcggtgcaactactgaaaatccttatttcgaagtaaatggagctctcctttcccgctccatcatttttgaactgaaacctctcagtaatgaaaatatccgcacgctgatcctcagagccgtaaatgactgcgataaaggcatgggaaattatggcgccgtaattgatgacgatgccctggaatttctggctgatatggcaggcggtgatgcccgcagtgccctgaatgcggtagaacttggtatccttactacccccaaaagcaaagatggttctattcatctgacactggatgttgcgtctgaatgtattcagaaacgagtcatcaagtacgacaaaaaaggcgacaatcactacgatatcatatccgcctttatcaaaagtatgcgtggttccgatcctgatgcagcagtctactatcttgccaagatgctctacgccggagaagatgtcaaattcatcgcccgacgtatcatgatcctcgcctcagaggatatcggaaatgcagatccacaggcattgcaggtcgccgttgctgccgcacaggctgttgaacgtgtcggcatgcctgaatcacagatcatcctttctcaggcagtcacttatatggcatgtgctccaaagagtaatgccgctgtcaatgccatttttgccgccatggattctgtgaaacacacacagacaactgttccggtccatctgcaggatgctcactacggtggtcatgaaaaactcggcaagggaatcggctacaaatatgcccacgattatccagatcactatgtcgaacagcaatatcttccttcagagattgaaggttctcatttctatgaaccaggtgatcttggctacgaaaaaacgataaaagaatatctacaaaagataaaagggagaactgattaaatcagttctcccatcagcattccataaatatcctgtgatttcttagcccagctgtgacacatcgcctgtgctgcttcccggcccggtgctgccagtgtcagatccagcactgtcgtatctttttcaatgatctggcagcgcactgcataattcccctgtggtgtcgtataataatctgccggtgtcagaatgcgttcctgcacctgtccgccatgcgtctgcagataatcttttacttcgttcttaatctcacccgacagttctttttcaaaataagaaagtgtcttttttccctcttccgtaatctcataataggaactgttggaaattgttcgctttctcagaagctctgtttctaccagttcagaaagtactttctgaagctggaaataatctgtgtaatctctgtccagtataaattctgaaatctgagaatttgtcagtgtttcttttgaatgtttcgccatatataaaacgatcagtttataagttgtaaatggttctgccatttcaatcacctctttctcacacaagtcaggcttctcgcttcttattgcagctgtttgccctgccagctgttacgaaccttcatttcgtgatgaagaagattcagaacttcccgcttccggcttgcccacaatggtgcaataagcaacttctccggtccatctcccgtcattctgtgaataacgattgacggatccagatgttccagacaatctatcagtaaattcagatattcttctctttcgtagacccggaatttcccggccacgtaatcctctgccagatcggttcccttcagcacatgcagaagctgcagtttaattccctgaatatcctgtccattcagatactgcattgtctccagaatgtctttttctgattctcccggcagtcccagtatcgtatgcacgatcacctcaatctggcgcttccgcaaattctgtactgcatcttcaaaacaggaaaggggatatcctcgtcgaatataggcagcggtacgctcatgcatcgtctgaagtccaagttctacccataccggtttcctctggttcagttcattcaggagatccagtacatcctcgccaagacaatccggtctcgttccgatggataatgcgaccactgacggatgcgcaagcgcttctgtaaagattttccgcaggtattccaccggtgcatacgtattggtatatgcctgaaaataagcaatatatttatggatcggccgctttgcagaaagcaatgcgatctgactgtcgatctgctctgttaccgacagctccgcatctgctgcaaaatccccacttccaccggcactgcagaaaatacagcctctgctgccaagcttaccatcccggttgggacaggacattcctccgttcagagtcaccttataaactttttctccgaacctttccctaagcatatgatccagcgaatgatacggctttccattccagttcttctgctgtgtcaccgcatctgtattcatacttctgtgccttcgcttttctgttcttcattttcttccttcggcatataatgatcaaatatttttacaaggaagaaggaattacagtacgcgatcactccgaatcccatgaccagaaacagagcaaacaacgtggactgtatctgataagagcctataaataacaacagcagcggacaaagtccgatcagtaccatgacaactgtatacggaagatggcggattgccatgaacagtgcatttttgatcgtattacggatcgtattgtaaaacctggcaagaatcggataaacatataaaaacagtacataatatatgatcacaaatgccataaagatcacatgaaaaatctgaccggcacttccaggcatatttttggcaacattcagatccagataaagaaccgcaccaacggcgatcatgatcagattaataattgtcgcctgtttaaaattatctttaaaagatttaaaaaagctccgaacaatataagcttcctcattccggaccatcttcagtgtcacataatacatagccgtaatagatgctccggcagtaacgatcggaatacagcagaccagacagatgatattcaaaatacaaagatctgccaccttattcataaatgtaaaaaacttattgtccatactgaaaaaacgtcccatatgcacagctcctttgtttctttcttcttctccggcttatgccggtctctgctttacagtataacgaaattcctgaaaaaaagcaatcaaaaccaaacagctgttttgtccctgctctatggcaggattagctggtctactgttacaagttcatattcctgatttttcagttcatcgacaacctgcagcgccgcttcaacagaagtatcatattcatcatgcatcagaatgatcgcgccatcctctatctgttcctgcactgtacgaacgattttttctgtattctgtaccttccagtccagtgtatcgatcgtccagaatacaggaagcatctccacacatagttccagatttttcttccaggcaccaaacggcgggcgcaggtacagtggataaacacctgttgtctcatagatcagattatttgttttcaggatttcttcccttgccttcgtctcattcagtttattcagctgtacatgatgataggtatggtttcctaccagatgcccttctttctgcatccgttctacaagttccggatactgttcaaccttctctccaagaagaaaaaaagaaactctgacattccgctctttcagaccatccagaagaagtggtgtatacctgatatccggtccgtcatcaaatgtcagtgccgcctgcggatgcttccgttctttcacagctatttccgtaaccgatgtttttcgtgcccgggcctgcatggattgttcaaccaaccgcagcatccccggacctgctatattttcagccaggattctgcctgaaatacggtgcgagtccatactttttatccgcaccgcagttatgatcagtacgatcacaaatatcacaattcctgcttttctttttttcatattccggtttcaaatcccagacatacctatccttctgttcagtatatgaaaagtggcagaaaaaaagcaccggggctcgcaaaaagccctcagtgctctgtaatggttctgtattttatttaccaagcatgatcttcagctgtgtttcaattgcatccacacatttgtcaaatccgagttttccactgttcagacagagatcataattcgtggcatcactccactgaccacctgcaaatttacgataataatcctgtttacgcttatcatctttgagaaggaatttctcgacatcctctcttgatccggagatcttctgagatgcctgctctacacggaactcccatggtgcatgaatgaatacacgcaatgtattcggtctgtccttgaaaacataattgacacatcgtccgacaattacataggattctttttctgcaagatcattgaccacttttgcctgatagttgaaaagattttcgtctgaaatgaattccttacttcccggctgatgcagatttcctttgtaaatgctttctttatttccaaaaagagaaccctttaccttatctccctcttctactttaccgaaaagtcttacatcaattccgctctcatcagacgccatctggataatctgcttatcataaaaagagattcccagacgctctgccagcattttaccaacggtgcgaccgccacttccatactgtcttgcgattgtgattacaacctgattcataccgatttcctccttattctcccagatatgctttctggacagattcatcatgaagcagatcatctgctttgccttccagagtgatgcttcctgtttcaaggacatacgctctgtcagcaatagaaagggctttcttcgcattctgctcaacaagcagaaccgttgttccactctcacttacttctttgataatatcaaagatctcatttacaaagatcggtgacagccccatcgaaggctcatccatcagaatgatcttcggtttgctcatcagcgcacgtcccattgcgagcatctgctgctctccaccggagagtgtacctgcacgctgtcctgtacgttctttcagacgaggaaatcttttgtataccatttccaggctctgagcgatctcgttcttgtcttttcttgtataagcacccatcagaagattctcatatacagacatatctgcaaatactcgtcttccttccggcacatgagccatacccatctcaacgatcttatgtgccggtgtcttggtaagatttttaccttcgtaaataatacttcctgcttttgccgggatgattccggtcagtgtctgtaaggtcgtggtcttaccagcaccatttgcaccgatcagtgcaataacttctccctgttctacatgaaaggaaattcccttcaatgcctgaatcacgccataataaacctggagatcttttacttccaacattgacatttgatcttcctccttattctcccagatatgcggtgataacagccggatccttcagaactttggatgtctcaccctgcgcaagcacctgtccgaagttcagtacggttacctcttcacagatacctccaaccagtttcatatcatgctcgatcagaagaatggtcatatcaaaatgtttctgtacaaaacggatggtatccatcagttcctgtgtttcattcgggttcatacctgctgccggctcatccagaagaagaagcttcggattggtagccagtgccctggcgatctcgagcttacgctgcttaccatatggaaggtttcctgcaagtgtctgagcttccttgtcaagatcaaatactttcagaatctccattgctttttcattcatttctttctctactttgtagtacttcggaagtctcaggattccggtcagtgtagaataagaatgatgattgtgaagtccgaccttaacattgtcaagaaccggcatatccttaaacagacggatgttctggaaagtacgtgcgatacctgctttgttgatctcgatcgtactctttcctgtgatatcctgtccgtcaagcttgatgataccttctgtcggtttgtacacacctgtaagaaggttgaaaattgttgttttaccggcaccgttcggtccgatcagaccatacagctgacctttttcgatggatacgttaaatccgtcaaccgcacgaagaccgccgaactggatagccagatgatttacctctaacattgccatagttaagctgcctcctttttgttcttagtgcctctgattttttccatggtacgagctctccagtttcttgctgccggtgcccagttaaagagcatcataacgatcaggacaatcgcatagatcagcatacggtagtttgcaaatccacggagaagttccggaagtgcatagagaatgatcgttgcgatcatagaacctcttaagtttccgattccaccaagcacgacatataccagaatcaggatagacatattgtagtcaaatccggatacctttaacatagaaaggttatgtgcatacagtacgcctgcaacacctgcaagagctgctgaaatagtaaatgcaagaagtttgaacttcgtcacatcaatacctacagattctgccgcaatacggttatctctggttgccatgatcgcacgtccgcttctagagtttaccaggttctgtacgataaacagcgtaagcaataccagaatgattccgatcgggaagaaataatgctttacgtctttataaagagcacctgttcctgaaataccaagtgcacctttgaggatctgtttgccgcctgctgcaagcttgagatttgcagaacttgttgcaacatgaagtccgttttcatcaaaaccgacatacaggatattgatcaggtttttgataatctcgccgaatgccagcgttacgattgcgaggtagtcaccacgaaggcgaagtaccgggataccgatgatcacaccaaacactgctgctactgctgcaccgatcagaattgcaaggataaatctcggcacctgcgggatatcacttgcaatgtgagaaaataatgcactggaatatgcaccaacgcacatgaatcctgcatggccaaggctcagctcaccggaaaaacctacaaccaggttcagagagattgccgcaatcgtataaacgcaaagcggaaccagcagacctgtaagaagtcttgagaggtttcctgttccggaaaggatctctacgatcacaaaaattgcgattacaattccatagttgataaaattgttttttgttgttttgttcattgtttttttcattctgaccaccccttatactttctcctggatgttctttccgaacagtccggtaggttttacaagaagtaccacgatcagaaccgcaaaacagatcgcatctgcaacctgagaagagatataggctttaccgaagatctcgatcacgccgagaagaataccgccgaccatggctcccggaatggatccgataccaccaaatacggctgctacgaatgccttaataccaggcatggcgcctgtatatggagtcagtgtcgggtaggtctgacagagaagaagtccggcaattgctgcaagtccggaaccgattgcaaatgtcatcgaaattgtcgcattgacattgacacccatgagctgtgctgcgtcacggtcttcagaaacggcctgcatggcacgtcctggttttgtcttctgtacaaaaagcatcagaccggccataatcacaatacaactcaggattgttacgatcgtaattcccttaataacaagctgtccgtcaaataaagacaccgacggtacatcaataacagttacaaaactcttggcatctgcaccgaaaatcaaaagtgccagattctgaagcaaatagctgacaccaatcgctgtgatcagtacagccaggttggatgacgccttacgaagcgggctgtacgctactttctcgatcaccataccaagaacggtacagaagattacagaaagtgcaacagccagcaccggagacatgcctcctctggtaacagcggtaaggatcacatatgcaccgaccatgatgacatcaccatgagcgaagttcagcattttagcgataccgtataccattgtataccccagggcaatgatcgcatagatactgcccaggctgattccatcttttaaataggataaaaaactcataatgcacctctttaaatagttgtcatattagctcaataaaggggaacggccctgtgataacaggcaaccgtcccccgtcctctgattacattattttaatctgattattccatttctacgtaagcgccgtcctggatttcgaaagcttttggctctttatcgcactcgccgtcttctgtccattttgctttacctgtaagaccatcaagctctacactcagcattgcctcagacatagctgcgctgatgtcttcgttggacatatccggtgtgatctcagctgcatctgctgctgctttcattgcatagattacatcatatgtatctgctgcgaactggttcggaacctcatctttgttagcatcttcgtatgctttaacgaatgcctgagatttctcatcttctgatgtagcagagaatggtgtcagaagcataacgccttctgcaagagatgtatcgaagttttctactccaagaataccgtccataccgtctacaccgaatttcttaacgtcgtccatacctgcatcatgtgcctgctgaagaatcagagcattgtctgcatagtagttaggaaggaacagaagttctgcgccgctgtctttgattttcttaagctgtacagagaagtctgtgttgctgtctgctgtgtatgcttcatcagctacaatttccagaccgttttcttctgctgctgcaacgaacgcatcgttgatacctgagttgtagtctgcggatgaatcatagagaactgctacctttgtagcaagactatgctcaccgatgtactgtgcagattttgttccctgtgcagggtctgtgaagcacatacggaattcgttgcttcctgctgtgatactgtccactgctgttgcagatggtgtaaacatgaatgtgctttctgctgcttctgctccgactgcaatacaggaaccggatgttacagttccgcaaagcatctgcattcctttgtcaagaaggtcattgtatgcatttactgccttctccgggtcagcctgatcatcacctgcgtcaagaatttctacgttgtatccgttgaatccaccgtttgcgttgatttcttctgctgcaacctgtgctgcgtggtatacaccaagaccatactgtgcgttgtcacctgtcataggtccgattacaccgatcttgaatgtctccgcatcatccgcaaatacagccgtcggcatcattgctgctgtcatagctactgctgctgttacagcaagtacttttttcatatttttcataataagatcctcctatcttatacttcagctagctttactttcatttgctaaagctttaatgtagttgattatagcattcacttatcacgattgcaagcagaaattttagatttatttaatattttgtgtttttctcgagaactcttgttgtcctcaagcggacattaggttcaaaaaaagaccgtggttcaataaagaactccacggtctccataattttacaacttatgctactgcttttttagcgatttcagcaagtgctgcaaatccttctgcgtcgtttactgcaagttcagcaagcatctttctgttgatgtcgatgtttgcaactttcagaccatgcatcattttgctgtaggaaagtccattcattcttgcagctgcgttgatacgagcgatccaaagctgtctgaactgacgttttttctgtttacgtcctgcataggagcttgcaagtgctctcattacagactgttttgctactctatactgtttggaacgagctcctctgtagccctttgccagttttaatgtacggttatgtcttttctttgcgtttaatccgcctttaattcttgccatttcttatttcctcctgttcgtcttccaatatcatctgctgcttattattataaataaggcagtgctttcttaatgttcttaaggtttgtagaatcaacaacagtagcttttctcagatttctctttctcttctgagatttctttgttaagatatggctcttataagctttatttctcatgatttttccggttccggtttttttgaaacgttttgctgctgctctacaagttttaatcttaggcataattatttcctccttaattcgtggtactgttttttatttcttattatcaagaacacgtgccaaaacacgctgtctgtgataactgcttaacgcttttcgctgagaaacatcgtcatgcttctgccttcaatcttaggggctttctcaacaactgccacatctgcaagatgttctgcaaaatcatcaagtacatgtttgctgcttgccatatgtgccatttctcttccacggaaacgtaatgtaaccttaacacggtctcctttagaaagaaattttcttgctgcattgaccttcgtcttcaggtcattggtatcaatgtttggagaaagacgtacttccttgatgtcaattgtcttctgttttttcttagcttctttttccttacgggagagctcataacgatacttgccgtagtcgataattttacaaaccggcggctttgcctgcggtgcgattttaacaagatcaagtccggcttcctgagcctttgcaaatgcttctcttgaagaaacgattccaagctgtgctccatccggtccgatcaaacgtacctctttgtctctgatctgttcgttaatcattaaattgctaattgtagtacacctccatacatttaaataaatgataaacctgaatctctcagctactgtataggaacagtaactccaccctgtcttatgaaaacaaaaaagagtatggacagtttccacactctgctatatccagggataaccaaatgaaacctctttttcatttttatctctgtgcattccctaatctctgtagatcagcctgctacgatatatcaacccgagccgcattatatgcgctgaggtgagagtgaaactctgctttgttttccacgtactttaaaaagatatcatgtcttttatataatgtcaagttattttttatacatatttttattttttcagcgcatactattcctgcatgacgtttgctgttatgcataatcatatcattatataagaaggaggcttctattatgacaattctgaaatgtagtgccacaaaatgtctttacaatgaaaatgagctctgttccagaggcgatattgagattacaggagataatgctcatcgtgcagatgaaacaaactgtggaagttttcgtgaccgcgcgactgccggtatgacaaacagcaaagctcatcactgcggctgtgaaaaaatcaacatcgactgtaaagctcaggaatgtacctataacgatcagcgcaaatgtacggcttctgccattgatgtggccggatgcagcacagacggatgtaacgaaacaaaatgtaataccttctcctgcaaatgctgatcctgacgctcaaaaagacgctgcatcaaacagcgtcttttttatgtctgaatcattcagtttctaatcctgtcgcttcctatctgtttctcaggaaatccggaatctggatatctttcttctgtactgtgctggtcggaactttgcctgtataagaaccattgttcatagtcggcagactgaagcttggcatggacattgtactggaagacggtgcagatgtacctgctgccggtttacgtacaccaaatggtgttgtattgcttcttgtaccaaatggagtggtctttgcagctgtatcggataatccggttgcaataactgtgatcttagcatagtctgcaacagaatcatcatacatagcgccaaagatgatgtttgtatcttcacctgtcagctcctgtacatagcttgctgcatcatttgcatccataagagaaatatctccggaaatattgatgatcacatgagtagcacctttgatggttgtctcaagcagcggagaggatacagcctgctgaacagcttccatagccttgtcatctcctctggcctcaccaataccgatatgtgcgattcctttatctgtcataactgtctgaacatccgcgaagtcaaggttgatcagtgccggcagattgatcaggtctgtaattccctggacagcctgctgcagaacctcgtcagctttgcgaagtgcttccggcatagttgtacgacggtctacgatctcgagcagtttatcgttcgggataacgatcaatgtatcaacagctttcttcagattctcgattcctgtaagagcattgttcatacgtgtttttgcttcaaaacggaaaggttttgttacaacgccaacggtcaggattcccatttccttagctgctgctgcaataacaggagctgcacctgtaccggtaccaccacccattccacaggtaacaaataccatgtcagcaccttcgatcaactgttttacttcttctatgctctcttcagcggccttctgaccaacttccggctgtgcaccggcgccaaggccttttgtaatcttttcaccaatctgaagtactgttggagctttgcaaagtgtcagggcctgtttatcagtatttacaccaacaaactcaactcctccgatggcttcttccaccattctgttaactgcattattaccagccccgcctacaccgattacaataatctttgcagaggactcagcttcatttgacataatctctaacaatgtacttcctcctttatttacctgatatcagcgtatcaggctgcatatagatatatcatatatttttttttcgaattaatcaactactatttttgtttttttatacttttttcactattattcgccatttccatcactcataagattcctcatctgtatctccctgatcccagccatccgactcttcatcactgtagctctcagtatcttcatccgaggaatctgtattcgtatcagaactgtcttcttctgaatcttcctccgaagtatcacctgaagaagtgccgtcattatccggcataggtcccacgtagttgccatctttgtcatactcgctgacaccatcaaagccaccggattcattatatccacctgtccagtctccaaagctgtccagaagttcctgcgtcggctccgatccaacatagttcagattttcatcatattcaccggaacctgtataatcgccttcttcgtcataaccgcctacccagttttcttttgcataatcaagtgccgtctttggttttgctcctacataattgccattttcatcgtattcaccatcaccggtataatcaccattttcatcataacctccggtccagttctctgcagttacttcctcttcctctttttcaaaagtcactgttttagaactttctgtgatattctccatatgaaggatccccttctcacccgtaatctgtggaagaatcgcaaccattctggacattttatcttccagatatttatcttttccaagttttaccgtgatgtctccataaataaggtctatggtggaatcatcctccagctggatataatctggctggagatcattttttgcaaaaatcgtagaaagtgcaaccgcagtatttagaacaacatccttaatcggaagtttttcattcataacaactttttttacctgaataccctcaaaataggggacagactcatccctggtcttgtcgccttctacaaacattccatttcgatcaaaatacacatagctgtcaagatatgggatacaacccactacacttttctcacggacactgatcacgatcgagttccgaccggatctgctgacggaatatccttcaatatatggcacaccctgcacattattttttgaacacgtgatcggtgccagaacagaattagaagaaaaagctcctgtaagaaccatttccttcagttcttcttttgtatagtggttactttccatcacttccacctttgacacatgaaaaaaagcaaagaaaaaaataatcccggccagaacagcaacagcagcagctcctccgaccagtttcgcctgtttttttgttattttaaatttcctgtaattggatgttctcataaaaaactaatacctgtatcctctgaactcatattaactcaaaccgataaaatatcctccatatagatttctgcctggaggttcctcaaatctctgcaaatgtcttcataccctcttcggataaaaggaacaccctctatcacagattctccatctgctgcaagagccgcaatcactagcgctgctccacctctcagttcctctgcccgcagcctgcatccctttaatctgcttccacaaatctttacttcgcttcccctgacttctatgtgtgcccccatttttgtaagttcactgcatatcttaaaccggttctcaaatatattctcccttatacggcttattcccggaactgtagtcagtactgccagcagtggtgactgaagatctgtcgggaatcccggataagcttctgtttccagaaacggaaccgaaaattgtattccggctccattcgctattagtttaccactcttccattcatattgtccacccattttccgatatacttcaaggaacgcctccatttctccctcaggtgcattctccacagtcactgatccacgcgaagctgcagccgcgcaaagatatgttcccgtaacgatccggtctgccggtatcagcatctctgtcccgtgaagagaggtcactccctgaacccggatgcacccttctttctcatgacagatccgtgctcccatcttttgcagaaatctgcaaagccatgtaatctcaggttctcttgcacaatttctgagtacggtctctccttcagccagaacagctgcaagcagtgcctgttccgtggcccctacacttctgtcaggaaaatttatctcctgccctttcagttttttgcaatctgcctgaatttttccgtttttttctgaaattatcgcacccagacttttcagtgcatacagatgaagatctatcggacgttttccgatcacgcagccgcccggataaccgatcacacctctttggtttctgccgagaagtgctcccagcagaatcacagaacaacgcattcttcctgtatattccgaggcaatttcccttccacagactttgctgcagtcaagatacagatcatggcccttccaccaggtaacgactcccagaatgtgaaggatttcttccatataacagacatcaagaatacgcggacagcctctcagaacacagatttccctctgaagcagtgatgcagccatgatcggaagtactgtattttttgatccctgcacagttatgctgcccttaagacagtttcccccaatcacgtgaatttcatccaaatgatccactcccacagagtctcttacagttaatatatgcaaagaccagacttccgtcacagaagtctggtcttatattacaatgctcttacatattctttgaacatgtctccacgctgttcataattatcaaactgtccccagcttgcacatgccggtgaaagaagtaccgcatcaccaggattggctttttcggcacatatctttactgcctcctcaagattttcacagagaatgcatgggcagacaccaagacgttctgccgcctctttgatcttgtcacgcgtctggccgatcagcaccagatatcttaccttcccgtcaaaagaattcagccactcatcataactggaacctttgtcgtaaccaccaccgatcaggatcgtcggacggttcattgcctggattccttttattgctgcatcaggattggttcccttggaatcattataatatgcaacaccatttttctccatgacatattcaatgcggtgttctactgctgtgaacgcacagatgctcttacggatattttccacagacacacctgcataatatgccattgcagatgccgccataacattctcaaaattgtgctgtccgagaagtttcagttctcctgtatgtaccagagggatttcttcgtcggctgttttcagtacgatcagatctccatccagataaataccctcgtccagttttctcacgcttgaaaaatacacagttttcggaacaatgtgtctgccaaactcacgaagcacttcatcttcatagttcaggatacagtaatcctctgctgtctgatttttgacgatcagttctttgacgcggatatattcttccatcgtatggtgtctgttcagatggtcttccgtaatattcaggattgcacttaccttcggcgcaaactcttcgatcgtttccagctgaaaactgctgatctcggccactgttgtggagctatctttcatttccagtgcctttgatgtatatggagttccaatatttcctactacaaaaacagaatcttctgcatcactcataatctttcccagaagagctgttgtagttgttttgccatttgttcctgtaattgccagtactcttcccttgccggtacgatacgcaagttctacctcaccccataccggaagtccctgttcataaaagctctttacaagcggaatatccgtcggtacaccaggactcaacactaccagatccagtctcttctgcacttcttccggaagttctcctgcatatacttcaatattgttgcaatctggaactttttttattacagtctctttatcaagatctttatttccatcataaatgacaggttgcgcccctactttcgccagaagctctgctgcaccgattccactttttccggaaccaaatacaagcacttttttcccctgtaaattcattttaatttcctccttattacctatgagcaagctcatgtggattttgacctttttgtccggacatcttataatgccagaagtgcgatcaggcacataacagcagtaattacagaaaatactgctacaactctcgtttctgaccatccacacagttcaaaatgatgatggattggcgccattttaaagatacgtttgccatgagtggctttaaaataagttacctgaatcatgacagaaagtacttctaccagataaatcagaccgatcagcaaaataaacagcggcatctgcatcatatatgcagcacctgccacaaatccgcccagtgccagagaaccggtatctcccataaacacttttgccggatatacattaaacagaaggaatcccatcagtccaccgacaacggctcctgtcacaggttcgatcccactctttgttccaatggaaactacggtaaaaaataccgctacgatcaaagtcacgctggaagccagtccatccaggccatctgtaaagttcacaccgtttacagtaccgatcacagcaaaaaacagcaccggaatcgcaagccatccaaggttcagataatgatccggccagaatgggatacgcattgcaagatcaatatttgtatagttcaggatataaaaaacaaaaataccggtcacaacgacctgcagtccaaatttctgccatgccagcagtccgtctgaacgtttcagtacaactttcagataatcatccagaaaaccgatgattccaaatccaagtgtcagaaacagtaccggaataattgccggatagtcttttacatagaacagagaagtaaccactgccgcaatcagaaagatcactccacccattgtcggagttcctgcctttttcagatgcgactgcacaccttccactcgttctgtctgtcccatcttgagttttctcagaaacgggatgatgactggtcccaggatcacactgatcgcaaatgagatcagtaccgggaatacaacttgaatattcatcctcacacctcttatcattctttcgttttttattacgtttgattataaggcttttcgtctgatttatcaactcccagatacgggagtatattttcgaagatacttctcacaacgggagctgcgatcgttcctccataataaattccctgtggatcatggataatacacaatgcaagaactttcggatcatttgccggtgcgaatcccagaaacgaagaaatatagcgatttgcacttctgggaagcgtctgtgatgttgcagtctttccgccaatccgatatccctccactgctgcattgcgcccggatccctcctcaactacctgctccaggatataccggacagtttcagagatcttgccatccagaatctttctgccattggaatattccagcgcctttactgcttctccatctgatgactcaatcgccactccaaaatgaggagtgatcagcgttccaccattgatcagggaactcacagttgctgccagacgaatcggtgtgatctgaaaagactgtccaaacgataccgtcgcaagttccacttctcccatattttcttcctgatgcatgatcgttcccgcctctcccggaagatcgatcccggtcttttccatcagtccaaactgtcgaaaataccgatagtacttatccacaccaagccgtaatcccacctcaataaacaccggattgcaggaattttccgcacctttcacaaaattctgtgctccatggcctcttcggttcgcacagtggattcgccgatcctccaccagcttatatcccgggcagtaaaaagaatcgttcaatgatactaccccttccgcgaggccggctgccatcgtaatgatcttaaaagtcgatcccggttcatatgtatcattcagacacggatttctccacatctgattcagaagatcctgttttttttcttcactcatcccttctgcatccatgcctgaattcagttcaaaaggctcattcagatcaaattccggaacatttacacaggcataaatttctccattctgcggattcataaggagtatggaaaccctttcggcctgtttttcttccatcactttctgtgccgcctgctgtacatatttctgtatatctgcatccagacttattctcagtgtatagcctttttgtggttcttctctgttttcaccgattccgtccagttcaatccctctcgcatccgttgttgtcaggatttttccaggttttccctttagaatatcatcatattccacttccagtccaatgattccctgattatccccgcctgtaaacccaagcaccttcgacgcgagtgtccccatcggatagtaacgcctgtaatcttcatctacttttatccccgcaaatcctgcatttcgaatttcatctcctgtttctttctccacatttgtacgtattctttctatggaagaaattttttctacttttttccgtacagtctgctcagatatccccagtttttctgtcagaagagcaatcactttttccggctcttttatctgactgtgaattacagaaatcgtacacactgttttatttgcagcaagtacttttccctttgcgtccacaatttcaccacgtgcggccttaatgtctctttcccgttcatgaagatcctccgctttttcataataataatccgaacgaaagcccataagatagatcagtctgccaatcagacacaagatcatcagcagacacaaaaagaaaacgatccacactttccttttatgaaatgtataattttttttcataaaaaaatcctctggaaaacagtcttaacaatatatgactgttctccagaggagatgtgtacgactctttatttagtccagcccggcctcttcgtttgtgatgccttcgctttccatatcgttattttctgtagtgtccgattcatcctcttccggtggtgcaggaacattggtatctgaaatcgcttccttcaacgtagtgtctgaatccgaagaagacgcaatcagatatgtggacatgatatactgtccgttatcatccagcttgtgttctccgttgtcatttaaaagatagccattttcatcaatacggtttccttcaagatccacgcggtttccactgccatccaccagatttcccttttcatccacactacttccggatacatctaccaggtggcctttaaatccttcccagagttctgtctcaggaacactgccgtcttcagattcatccggagtaacattcagatacggaagaagttctgacagaattccctgcgcgatatactgcggatatttactgtcggcctggtcctctgtattcggttcatccacaactacatagagcagaatctgcggatcatctaccggagcaaatgtaataaatgaaaccagatatttaccatttcctcgcggaagtttttcggcagtacctgttttaccaccggaactgtaaccctgtaccttggatgtaccactggtaccttcctgcacgctggcctgcatgtaagaacggatatctgctgatatctctgaagaaactgtctgtttcataaaaatcggatcaaatttctttacagttgaaccactgctgtctttgatctcacttaccagatgaggctgataataggagcctccattgataacagaacacattgcattgatctcctggatcatcgtgcaggtaaatccctgtccaaatgcagaacaggcaagttctgtttcacccatggtatctgccgtatgaataacacctgatccctcatttggaagatcgattcccgtgcggcttccaaagttgaacaatgtctgtgccttcaggaactgttctgttcccatttttgctgcgatctgcatcatcgcatcattacaggaatttgcaataacatcccgcagtgcctctgtaccatgcgcatccggccataccgcacacttgatatacgtatcaccattcgcaccaaacgtctgtcctccatcacagacaaaagtatctgtttctgaaatcttgcctttttccagtgctcccgccataacgatcggcttcacaacagatcccggttcatatgtctcagtaacacagaaattactccacatggcattcaacgccgtcactgtatcttcatcactcattgccgcaatttcttcttcggaacacttgctggaaagatctcgcggatcattcagatcatagcggtccccgccatccatggcaatgatctcaccggtagatggcttcattgcgatcacaccgatattttttgctcccatggcttctttaaatccattaacatatttttcaacaatctgctgtacacccacatccaaggttgttacaatactctgtccgtctttcggatcgatgatcgtctgttccacatctgcattgtcattgatatatccatactgacggccatccgtccccatcaacgtactgttatagtaactctccagccctacgtctgccgtatctctggaaagtgtaaatccaatcgcatcatttgcaagctcattaaacggataacttctcagataatcttcttcaaaccataccccttttatatttgcccgctctgctttctgtgcatctgacagctcgctgtcttcagccggagattcataatcttcaaaagcttttttctcatccatggagagctgcttcttcaggatctgatactggctgttcttcgtatcctcggcggaaaggatcgaccgaatcttgtcttcatcaagtcccagcacgtctgtcagtgctcttactgtcggttctacatatttttcatcagagttgacggtcttgcagtcaaggatcacagaatacactttctgacttgtcgccagaatattaccgttacggtcataaatatctcctcttttcgctggaagagtactgctctgatacttctgctgtgcctgtgtcagaacctgttttttgtattttttgccactggtagcattaatataagtaattctgcccagtaaaccaactaaagctagcagcactacagcgaatagtcctactagctttcctctcattttgtgattaatttttttctgaggtcttcttcgattcctcgtattggtattgctcaatgatctatcacctcttggactcaggaacttcctgatactgtcttacataactgttactcggcatagtataagtctttttctggtcatctttcggataattcattcccagacgccctatggcaagcttcttgatcgtattcagatccacatctgaagttacctgactctcatatgcattgttgtcttctttaatctgtgacagttctgtttccagagaagcaactgtttttatcttacctgtcagctccgatttcagctgaagataattgacacagcaaaaaagtacggcaacacttaccgctgcaaggaacaccacaaaaccgcgtcccatgctctttgctttttctctgtttctctgtgcttcccgactgagctgtctcggttgagctgccggtctctccggcatattttcacgaactcgccgcgcggtctgcactccaggagcctgatacggtctcgcaggaacttcctgcagtcttcgcaccgcattcccatccacatacattccacgggcatttctggcatttgttctgttttttctggatgtgactgctctgttcgtcctctccatctacatctcacaactttctacttctatacttaattaaagatatcttctttcaaagattctgagttttgcactcttagatctcggattctcttccatttctgtctcacttggcagaatcggttttctcgtgatcacttttcccttggatttcttgccacatacacatactgggaaatccggtggacaggtacatggattttcattttttcggaaaattgtttttacaatcctgtcctcaagagaatgaaaggtaataatacagattcttccgccatcatccagaagatcgatcatcccatccagtgattctctcagaacatcaagttcccggttcagttcaattcggattgcctgaaaagttctctttgcaggatgtcctccagttgcctggatcttcatcggaatcgactgccgaatgatctcggtcagttctccggttgtctgaatcggtgctttggctctcgcagccacaatatgttttgcaatgttttttgcaaatttatcttcaccgtaatcacgaatgatacggtacagttctctttcatcataaccattcacaatatccgcagctgtgcggctctgtctctggtccattctcatatccagcggtgcatccacacgataggtaaatccacgctcttcattgtctaactgataagacgaaactcccaggtccagaacaattccatcaactttctgaattcccagattcttcagctcattcgccatgtaacaataattgctgcgaataatctgaactctgtcaccataggcggacaaccgttcactcgcagcaactattgcatcttggtcctgatctatgccaataaatctccccttggcagaaagtctgcggcacacttcctgtgcgtgccctgctcctcccagagttccatccacataagtaccatcaggttttacccttaaaccatcgatggtttcttccagtaatacagatttgtgtttaaattccatatccgtctcctgttggatttctttccggcgtaatgcttagatgatgatacccatgtcctgcataccctctgcaatactgtccatatcatcataatcacaattctcgctccacttctctttgctccatacctcaattctgttgaggtttccggtgagcacaacgtctttttccagaccagcgaattcccgtaacgtctgcggtacaagaattctcccctgcttgtccagttcacagtttgtcgcacctgctacaaagaaacgtgtgaaggttctggcatttttgtttgtaagtggtaaggctctgagtttttcttcaaaggcattccattcatccataggataaatagagagacaaccatcaagtccctttgtcagaacaaactcctctcccaggagttctctgaatttggaagggatgatcagacgccccttcgcgtcgattgtatgattgtattcgcccatgaacatataaactcacctactctcgtgagatacgattctccccttcgtatctgccggcggaaatggataaatatgccacattccctccattcaccaccactattcaccactttctaccacttataaagtcattctaacctatttaccttgaaaatacaagtgggaatcgtagtttttttctgaacaattttatacattttaagcggaaaattgccatattttacgagagtattacagaagattttctaattttcaaagttgtttaaaaagcgaagggggtcctccctttggagaaccccctttaactctgtcacatgtctattttcatgttacccgtttattatttatacatcttcgcgatcatccggtccagcctctggctcagcctcagctgattcggcagatccctccgttcccttattctctgattcaacagtttctgcagacgccggagcttctgccgcttccgcatcttcgacagactctgaaacttccgtttctgtcgtttcagcagtttctgcggattttgaatcttccgactcatttgattccgtatcttcttcagccaccatctttcccgctctatccagttcttcaagaatgtctctgaactcatcctgtacattctcaaagttatgaatgtcttccagtctgctgccatcatttttctcttctgcggcattacgctcctctctcctgcgtctgctgaccttctctcttttctttgaaagaatccttcgcactgtcgcaacaatgccacagatcaagaaaagtgcagcagacacaagcagggaaaccggtatctttgtcttcggaatatacagtttatccgtgcgaagccactcgatcacacacttgcccagcccgtatcctgcaagatatctgagaaagatctcaccttcaaatttttttctccaggtataaagcagcaaaatcagaagcagcagcagacaccagatactttcatagaaaaacagtggatgtacctgaatgtaatccatatctctgaaagttaccagatgctgtttcatcagctttgtcactgcgctcttctgtacggaatccatcggaagtcccattgcaaacagactgtctgtgtactctccaaaagcctctcggttaaaaaagtttccccatacacctattatctgtccgctgagcagtcccatacatacaatatctgccattttccagaatgacgttctgctgagccgacagaagagagctgccacaagcacgccccccagaattgctccataaatagacataccaccactgcgtatatcacacaggatcttccaggatttaccactgaactgactccatgaaaaagcaatgtaataaagcctgcctccgatcactccaccgaccagtgccgagattgacgctcccaggcagagattcagattcaatttctgccatctggcgcagagaagaatcatccccagcccaataagcagacttacagccatcagtatcccgtatattgtgatatcaaatccaagaacagaaaaagttctgtcctcatattcaaacaaaaaccccagattcggaaatcttactgttatctccataaaacccctttatcatatacttcgtattatcggatatgttgtacagaaaccgatatacctttaaggctatcgatttttatacattgaatctgaacaggatcacatctccatcctgtacgatgtattctttaccttccatacggacaagtcctttttctcttgcgcctgcataagaaccacagtccagaagatcctgataattcacaacctcagctttgataaatcctctttcaaagtctgtatgaatcttaccggctgcctgtggcgcctttgttccgattttgatcgtccatgcacgagtctcatcttctcctgatgtcagaaagctcatcaagcccagaagtctgtagcttgcccttaccagtttctcaagaccggactctttcagccccagatcttcgaggaacatttttttctcatcatcatcaagttcagaaatttcttcctcaatttctgcacagatcacaaatacttcgctcttctgctctgctgcatatttacgtaccgcctgtacatgagcattggattctccgtcatctgcaagatcgtcctcacttacattggcagcataaatgaccggtttccaggtaagcagattataggttcccatccatgcttcttcatcttcattttcaagttccatagtgattgccatattgccgtcttccagatgtttcttcactctctgaaggaaatccagttcttttgcagcctctttgtccatacgggctgttttagtaactttggcgattcgacgttccaggatctcaatatcagaaaagatcagttccagattgatcgtctcaatatctctgagcggatcaatgcttccgtctacatgaatgacattcggatcttcaaaacagcgtacaacatgtacgatcgcgtctacctcacgaatgtttgccaggaactggtttccaagtccctcacctttggaagcgccctttacaagtccggcgatatcaacgaattcgatcaccgccggtgttactttctttgagtgataaaaatctcccagaagtttcagtctctcatccggtacagtaacaaccccaacattcggatcaatggtacagaacggataattggcagattctgctccggcttttgtcagtgaattaaacagtgtactttttcctacatttggcagtcctacaattcctagtttcatttttatatttcctcctataaatccttagatttcaagggatttcagcatacttactttaataggtgggccatttagtgggccatcatattgccataagcgcttctgctaccaaatcaatttcttttttcttttcttcttcggtagtatgaacatataagttcatggtaattccaatatttgaatggcccagtagcatttgaagtgttttgggcttcatacctgcttcaatacatctagtagcaaatgtatgtctcaaaatatgcattgaaaatctaggaatctgtgctttgtcacaaatcttaaacaatgccgtatcatatgtactgttcttaactggtgtcccctttctgcacagaaacacaaactcttcccattcttttgaaatttctgaaatccacttattcttttctttttgtttattcagtatagcaaccgcttcttctgttaaaggtatcgtacgataacctgatttactcttgggttctccaatacgccactcttttacactataacggtattccatactcctgcgaatctgaattgttttagattcaaaatcaatatcttcccatttcaatccaactaattcgcctgtcctcaatccggtttgaagaataaatcgatactgattttcataactctgcccttctgcatatctcaaaaatattttttgcacatctctttctaatgcaactttcttctccgaaggttttcccatatcactctttactgaccttttacagggattcgttcgtaatacttcattttcttttgcatattcaagcatattatataatgtaattcttgcttgataaatcgtggacgtacgatagccttgatccgccatatcataaaatatcttttgacaatgtagaggtttcacatctgataatgacattttcccaatcaatggtttaatatttcttatatatctctccgtataattacgaaccgtattcggacggactgttttcttctttattccaatccagtaatcaaaccaatgatccaccaacatatcagacggcattgaaatatcactatgttcatctacataaatcgcatctgcaagccaagctctacactcttgtagctttttgaatcgtttatgctttctctttccaaaccgatctacaaatcttgcggagtataatcctgtactttcctgtgatatacccacaccaagttctttgccttttaaatcttttcccatattttagctcctttcaaagaagccctaatacagtatcttatattataccataccattttatctttgtgaatattcaatttccatctcatctcctatctcttaaatctctatattttccgagataaatctttcaaattcttttctctttacaagtttttttgctcctacataaagtacaaatggacattgtggttcttttaataaattactaattctattttgtccaatattactatattcagctgcctcttcaattgtaagagccaccttttcataaatcggtacatatgctttattcataatatcctttccctgttttacgtgcatagcataaatttcacctcgcaatacacacgaccattttttgaaataaatggtaaatatctttgacattggcggctggcaaaggtatctataaagactgccaatgccaaagtagttttttgccaatgtcatcctttattctgtgattaacgcaactgtttttcttccctgacaccagtcgtagcttaatctactttccaattgctttcttgcatctcttcctgttctggaagaaatcccataggctagtagttctgcctctaattcttctaaacacattacttttcgtttgtttaataactccaggatcaacttctgtgccttttccagtttcgtttcctttttcgttcctgcttttcccatcagcagatcttcaatggatatatcgtattctcctaaccattttaagccttcttctcctaaagaaaacgctaccggattttccttcttagcaagagaatccttttgctgatataccactcgaatatcctggtccttctctttttccaccttttctacaaataagatgcttcgtactgccgctgcgatatcaatggatcccaaggaacggtaatcgctctgacttcccgatgacttattcaaatgtccaatgagaacaatggcacatccagttctctctgcaatcgtactgagatgtcgaaataagggacggatctcattcgcccggttcatatccacattggctcccagataagcctgtatgggatccatgatcatgaggcgtacattattctgtcggatggctttttcaatccgatcgtccgtcatagaaagctgtttttcatcttcattgatgaagcgtactcttgtcatatctgcaccacattttgctaatctaggcttaatggtatctgctatcccatcctctgctgtttgatacaacacattaaagggttctatgggaagtgcattgggaagttcttttccatttgtacagtatgcggcgattgccattgcaagccatgtttttccttttcccggattcccttggatcaaagtaacctttccaaagggaatgaagggataccataaccactggaccaccgtttcctcaacctccgacattttcatgaccggaactggtttttccctggcatctctccaacacatctgctttgccatattttctactggaacttctgctaccagacattcattccagtctttcttcaccggttctaatcggtacacactcagttccttcggaataagagaaacaaactgcctgcatctctcatttccaggctcatcattatccagacacaagtagatggaatgaatatgaggatattctgtatacatccgtttcattgctttttcactcaatccgcccagagaaatataactatgctttccccagtcttccggaactgcagtgatataagacaaaagatcaatgggggattcaaacacaaacagtttttcatccgttcctatatggccaaatccataggctttttccgaacctcttgcctccccacgatatcggttctcatcggttccccgcatagctgcatatctaggattctgttctttgtctctcccgacgaataccacattgtgatagtttttactttcataaatatccccctttgcaatcatctgatctatcagccattccgatagtttcctctgctcaatgagatacttccttgcaatctcacagctttcatttctttctggcaattccaatccaggcaaggggatggggcagaccttctgtctgcctgcatcttccttggccgttcttctgttggtttctccaactccctcttctcctaataattctttgactgcctctgcaaaagaaagaccgtaaaattctttcataaaatcgatggcatgaccacctttattctgactaaaacgataccattcgttcttgttgatcatcacactgtcatgtcgcaaccatcggtattccttcccacatcgtttgaactgttctcctctcccagaaagaaaaacatataaatcagtatcatctgctctttgaatctgttctcttgtatattcttccatcttctaaaattcctcctataactccattccatgatgtttcttctttcgtttcatggttctcactgcttcttttgtttctgtggattgctcccgtttgtttgtttctggaagagagacaccttctccttcctctgccatcaaagcttccacatgatttttgattccctcatactttcgtaacatggcatggatccgtttatcttcttttcgtaaagcagctatctcttctgataaacgagcggcttctcgtttccattgtccttccggaatcttcccacttgggtctagattttcttttaagattctttccgaacgataatatccgttaagttccttcttatgttcctccttgaatttttccctgccaaaatattttttctttaattccagataaacaggtcttgtttcaaaatactctttcattgcataaatgttgacattgaccctttgtaaagcagccagttgttttttcaacctctggctcacttccttcagctgagtatctaattcctggattttctctgtcagctgttccggggttctcacatcctgctcttccagaaagcggatcgtctctgcaaattgtttcagatttgtattcttcgccttttgtgttccataagcgtaggattctgcgactgcatttctcttgtcataatagtttcttagataatccgctaaagttggctgatgtaagaacagcatccgttccatcaactggctttgtcgaagcaaagaccattgaagaagattcttcgctcgttctttcatatcatttaaggcacggatgagtctgtttaaacttcccagtgcagttgaaattcctcttgcttccattgcctgtacattcggtccttcatgcaccatcgggatcttatcaatccctcgttcctcataagatctggcatcgactctttctgtaagtcctttttcttcatacaattcgttgcacatcctcgcccaggcacttctcaattcttccaaagtttctttcctgctccaatccgttgtatgtaccgcccgaaataccggttgtcctttctgattcaaaaccggctgtccatccggtgtcagtactggaacctttttttgtttttgtccccaggtaccatcttcctgtaaagggcggatgggaaccatgatgtgcatatggggattggggattttatcctttaccttcttcggatcatggattgtcagatctgcaatcatccctcttgcgactaactgttcttctacaaatcttcttgcaagctcaatattttcttccatagaaaactcattcatcaaggcaatatcaaagctgtgtgccagctgtgctttcttattcccttcgatccattccacctcattccaaagggtctccctgtctttgaatctctccggagcctgttggggaagatggatctccgctaataccacaccgccttttctcgtataatcacttacttctccataatacgtacattccagttttgcaccggctcgataggcagcactggcaatggcagactgtccttttcctctggataattgattcagatgaaagtgataacatcccatcttacgcatctccctgtggcagttcacctcgttgcatcgcctttaatagtgcttcctcttctgctaattctcgttcctttgcttctgccgcttccgcccgtccacgaaccatttcatgaacgacatcacaaaacttacaagcaggatcatgaagaagttcatccatcagctgataaaattccgcctctgtcagatatttggtatctttacagatagcttctatagctgctcctttctggattaacagatgagttcgtgcctttcgctttttctttttctgtgtgtctagatagttcaaggatctctggatcctatgctctgcctgttccttctcaagctttgcctgtttcaacgcagcttctgttttttcaatctcaagaagtgcttcctgagtatattcctgaaatgttttcttcttcgccatatcgttctttttctcctttttcaactcttccattttctctgttacgggataggcatttctgccggaaggggaatccttcttcggatggatcatccgcaaacactttcggaattccccttcagaaagatgctacttccgcaggacgcacataccttttaaggtatataagtgcgctcttctgctttcagcatccgagtttttcttactcaaacggaagttcttctccgtctggaagatgcataaatccatctggatcggtatcttctttcttttctgatcctgacagtttcttcccttctgcgaaataatgttcttctacaatcacgttggtggcataaactttattcccctcctgattcacataacttcctgtctggatccgtccgcttactaaaatcttcaaaccttttttcagatatttttctgcaaactcagcatttttcccaaaggtgacacaagaaataaaatccgtttctgcctttccttcctttcgatatcgtctgtctactgccagcgtgtatcgtgccattgcagtactgttttcatcctggagatatttcacctccggatcttttgtcagtcttcccattaagattgttttgttcatgtaatttctcctttcccttttcgttttttctttgttcttgaatcaggcccgattcttttaaggcaaatgtaatttgttcctcatatatcagaacgtagagagggctttttacaaataaaaaggaattttatttttttgtcctcatataacgaaaggctcagaaggaaaaatacagggtgaaaaaggaaattttttatttttctgcacaaaaaatacccctatgacttcaaaattgaaatcataggagtatttaattcaacctattcagtagggtgttttatattttcttttatacatgttattacagtgtttttcaattcgacaagctgggatttaattattaatgcaaatcatcttggtcaattataaattttctgcatttttcacaatagaatacttttacagtcataccatcatttattgatgttagtttaatttctctcacaagtggggtaaaattcaataatcctctatctttatcagacggaacccattttagtgcatatcgatcttgagaaatgcttccaataagcatttcttctttgcaaaatggacatttcatatagttaacgcctcctaataaaataaattcaaatttctacattgttttatgtaattttcttagtttatatatatatatatatatatgctatttgcgttattacatatatcgcaaagaacataaagaaactacctaccgaaatttcacctatcagtgccattatagtgattgttgcagaaaacaaaactgtcataatatcaaaagcaaaagactttgcaattctgttaatactaacatttctttcatcgttagcttcaatttcaaattctttttttatttctttttcagatttaacaaaaacatcgcaaactccaccaacgatgattccaattccgattacaataataatgaatggtaacttgtcgtttgggatatctacataaccaaatttgtctaagccatatccaaataaacttgcacagattagaactatacctattgccattgtaagattgttcaatgcttttttcataatttttcctcctcataaataaatatgtcttcaatactcatatcaaagtatctcgctattttaaaagccagtataatagagggattatatcttccattttctaaagacccaatcgtttgccgagatacttcaagtgctaaagctaaatcctcttgcttaattcctctctgttttcttaattcttccaagcgatttttcatatacctctccctattcacggaaagtttgctttccattcttaatttcattatatcaaatcctactataatgtcaagtttgctttccatctcaattcaaaaataagccagttctcaacttcactggcttatatatttaatacaatatagcatcgatataaaatctcaaatcttttctgccttcttctagaagattaaatcttatcttttttcttccatgcaaaaaaagtaatcataacgtttatgaataaaaacaaaaggaaaaacaataccgtcaatataatcggccaccgaaacacaaaatacgataacctattttccatatagcacttcacaccaagtaatacaactgctcctaccgtgaataacaatcctgtcacacatagaatataatagaaaccctctccgtaaagcatccatatcatttgttcatctgtcaatccaatactttgcataatctgaaattcttttcgtcttgaatatattccagttaatacaacattaaaatagtttgtcatccccgccattagtaaaataatacatactgatcccaaaagaattctgtttcctcgcatatatgtttccttttgttgtattagatcagatttagatatagaaaatataccagcctcgccaacaccttcatccagtgacacttctgtcatttttgagcgttgtttattctcttcagaaattatttcttgaagctttgattttatataattttctctattaggatgtacatttaactctattgctaatgtttttttatccgttggaattttttgaaatcctttttcactaattagaaaatacaggctatcttctgctccatgccatgattgatcgatttctggaaattcatcgctccgactatccaaatatccacacagcttaaacatctctgaacttttttgtgaaaagcttttttccctatcataattacattcttctctactttgaatagcatcatttctcgaaatcatcgtcttgaaatatacaggctctccaactacttcatctgcgtgtttttcctgtttgggagtcaacatatgatcatgcaaaattaatactccctttccttcttccagagaagttatatcaatattcagttgttgattatgtacatattctttgagcaattctacttccttttcttttagaatctgtacagtatcccaactaaatccttctaccatatttccttcaccaatagtagaagctccctctgaatatggacggattcctcttcttgaaataaccgtatttagataggcaccttctatcttattagattttttccaatcaattccttttatattatgtattttttcttctacattttctgatatgggtgaaaattcatcatatgcgttatcatataataatgctattccatccccttgtgtcaacattggatcctcatcaatttctctcgttttatattcttctccataaccttgactctttccatattcgctaaactcgcccgctaataaaaaatctggacgattttcaagaacatgcatataatcacttccaaccacgattacattcataaccaaataagataaaattccaaggaatatggaaaggcatgtaatgataaatcgtgctttattacgagagacattcttccatgcgatatagaacatttctcctacagttgtgcgtttacgtatcatttttctagcatgaaccgattgttttactctaactttttcatcataaacgatactttctacacaggacatattcactatttttctaataactttttctgaagctatccacaaaatcccattgacaaatacaagagccataagaagaatctctggtctaaaaaaatacaaaagagtttttccacccatttcttgataatagtaaactcctaagatattcggtaccaaaacggtcaacacaagtactgaaagtaatactcccaacaaggagcctcttaaaagaatccattgcatttgtctacgatagattttggaaatctgcctttctgtggctccaattgtattaagcagtcctagattttgaatatcttcactcatagatatccacaaaacattacacactaggaaataaatgccacacaaaatactgattgttcctactattaccatttcgtatccgcctgtcagtttagcaactgcaatatgctgagctgtatcggagacttttattttttgatcatcgcccttcatttgcaatgttttatataatttttcttccgttttctcacaactccaattatctgcttgccgaaaaagtaaagtataatgattttctggaatgttccattcttctattttattttttgaaacatatcctacgggctgttcgccacttgtttcttcataccacccacataatctgaatgtttcttttctacttttaaaaattccaattgaaatatctaattctatcttcatgccttgttcaggcttagtaattcccatttttttcaacgctctattaggcaacaaaatttcttcagttgtttgaggataataaccaataatgttagtataagccggttgcataaaataactccagctatcactatcaacccatgcaatttcacaaactgattctattttattttcgtaagttccttcggcctctccaacaaaaatgcttttccctacttgcttaatataatctagttgttttaacttctcatattgtttgtcggatccatctagcaacatacctgatgaagctgtccctttttctttaatcaacctaatttcttctgctttaatctttccaaatggtattccaaaaaccatagtaatcgcagcaatgcttatgactacagaaaaaaacaaaactgtatttcttatcttttttgttctagcaaaattctttcccaaaaatcgaataacactttgattattattagggatatgcttattaaataacatcgcactcccccctaatagtccatactgtttgtcacgcaaattttcccatctgacatacgtattatcctatcagccatttgagcaacctcttcttgatgcgtaaccactaatactgtttgatgaaatcgaaaagcacacgactttaacaacgctacaacttccatactcgtaactgaatccaaatttcctgttggttcatctgctaaaacgattgctggtttcattagtaatgctcgagcaatcgcagctctctgttgctggcctcctgataaagtcgaaggaaaacgatccaacttatcttgtaatccaagtattgccacaatctcctcaaaaaaatctaaatctattgttcttccatctaatctcaatggaagaacaatacagactgtagacaaagccctgcttttgcagggttttgctattgttggaaccgctttcatgagggtgcggatgcaagaaagattgaggaaaaatatctcaccggacagataaggaaaggttcatggaaggtagaggaaaaccagatgattaaaaaacaaaatgcactgctgcaaaaggtaattgcaagctttggtaaggtatccggtgcattgtcagtatggaaggagtggttgaatgacattagaagaaagcaaagaaataattcccatgatggaagcaatgattacacagatagaggaacagcagaatatcatggcagagatgcttcaggaaatacaggaaaaggacgagaagctgatgtgctttcaggagcaggaagaacgattgcagcaattagagaaagaattgtcagagctgctacaaatcttaccagatacagaagaattgttgatgcttctggaagaaaagacagaccagatacagaaactcacagacgaaaatcagcaatggcaggaattggcacagaaattaaacagcgagaaccggctattgcagaaacagaacagcgaattactgaacttgaacagcaattagagaaaggaaggttgattgatgaacgaattaagaaactcaaagagcgacgatcaactggaagagttacttctgctgacagagcagatgcaggaagaactcgaccagaaagaccggactatccgggaactgaaagtgcagctcgacgaatcgctgaccttgaacgagaggttaaacagcgagaacagagcagggaacattcaagccttaaagaacgacttgaggaaaacaaaagaattgttgcagagcgagaaagagaaaacgcttaccgcaatggacatgatagaggaatgtcgagataagctaaggcaggcagaacaggaacgggattatgcactctcccatcagaaaaaaatagagataccggttgaaaagtcggtgctctatcaaaagtgcaggaattgtaaccacacagcttatctgaaagcgaaggaaaggtatgatacgcagagagaaaaaatggcaggcagatataaagcaaaaacagctatgtatgaagcattgatgtttctgctgatatggtattccgcatcaactactctttttcagatgatacagtcaaaggtatttgtttctgattgcggaatattctttgatgcaatcggaactttcacacagactattgctggctggattgcactgataggaaagaatgtggcacagattagtaatggaatatccaatcctgtcattgccggaattatatactggctgataagaatattgatttgcggtggatgtctggtgggtgcgggaatatttttggcattcatcggaataaagattgtaggtctatataagaaatactgttgggacatgattaccataatggtaatacttataagcatggcaacagctatctactttgggaattggataaagacagcattgccaatcaatctgctatttctcttattattcgtgcaactggtatatgttggaatcaggtggtatgtaaagggatggcgggaagcaagaggatattattaaaaatccgattgtaaacacacaattttatgtgcttaatcacatctctttgcattttaataaaatcctacaaaatccttgaaaacaaaggattcattgtaatgtgttcgctttatccctttatatgatttcacactatgttccccttgccctgactgttcataatggtaaaagcaagggctggaaaaacgcataacgcaatacaacaaagtgtagcaattgggatattatgaacgaagaaatcatcttttcataagcagtcaataaggctgaaggaattaatctctgccgccttattgactttcaggtgggcttcaattataattaaatcagctgatttaaaacaagcgatttagtaaaaggagagataaagtatgccaccaaaagccaaatttacaaaagcagaaattattgaagccgcattaaatattgtcagggcagacggatatgaggctttgacttcaagagcgttaggaacatatctcggtagttcggcaagacccatttttactgtatttaaaaatatggaggaggttcagcaggatatgattaaatctgctaaagctctgtataaagaatatgtcaataaaggactaacaacagagcacccgtttaaaggggtgggtacacaatatattctcttcgctgttaatgagcctaagctttttcaactcctctttatgacggagcaaaaacaaattcctgacttatctggtgtacttccgctgatagatgaaagttatgagcaaattctattgtcaattcaagatgattacaaaatttgcaaggcagctgggaaaaaactgtatcatcatctttggatatatacacacggaattgcaacgctttgtgccacaaaaatgtgccgatttacagacgaagaaatcagtacaatgattactgaggtatgtatgagtattttgaaaaagctgaaggaaggagaaaataatgattaaagcgagaaatataataaaatcctaccaaaacggagaaagccgattccaagtattaaaggacatcagtcttgatattgaggataatgattttgtggttattctcggcgcatctggttctggcaagtcaacctttttgaatgtaatttcaggtcttgaacgccctgacagcggtaaagtgttttatgacggaaaggatattacagcactttctgataatgaattaacttcatttcgtaaggaaaatgtcggatttatttttcagcagtattatttgctacccaatatgagcgttgataaaaatgtaaaaatgggtgctgatttagcaaataataaagattataaaaacgtcattagagcggttggactcggagaaaaactacataaatatcccagcgaactttcgggtggcgaacagcaaagagtatctattgcaagagctttggcaaaaagaccgagagtattatttcttgacgaaccgacaggagcattagacgaacaaacaggacgacaggttcttgattatatatgtaaacttcaaaaggaatatggttttacgattgtaatggtaacgcacaatttgaatattgcggaaatggcaaacacagttataaaaatgaatagcggaaaaatatctgaaatttacacaaatgaagcacaaaagactgcttatgagatagggtggtgatggtatgctcgttggaataaaaaatgtttcaaaactcatcggtatttccattatagcctgttgtgctgttcttgtttgtacaatgtttctgaacttttattttgatattcgattaattgagagtgaaattacatctgaattatcaatgtttttttataatgctcaggtttctaccgcaaaagtcgtttgccttgtaagtggcggatgcttgcttttaactgcgattgttatgttgttgttttatattaagcattatattgacacgcataagaaggaacttgggatattaaaggcgttgggatattcaaatatcaaaattgcaaaaagcttttgggtattcggaattagtatatttattggaactgtaaccggatatgcaggagcatttcttataatgccgtggttttacgctctacaaaatgaagataaaatgcttcctgagataactatcaattttcatccaagcattttattttattttgtggtattgccgactgtgtgtttttcggcactttcagtttattatgcctggtacaaattcaaaaaacctgtgttgctgcttttgaaagataatatgcaaactgcttctaaaacaccaaatcatagaatcgaaaaaagcagtgaattgtcgtttgtagagtatttgaaaaggaataccttgaaatctaaaaaggcacttgtattcttcattatttttgcttcgttttgcttttcagctatgacacaaatgtcgtttagtatgaaagatttatcaagtgaaatgatgggtgtgatgatgttggtcatcggacttgtattagcgtttacaactctgtttcttgctataactacagtaataaacggaaatacaaaaactattgctatgatgagagtattcggctattcacagaaagaatgttgcagggcaattttaggaggatacagaccgctgtcctatattggttttataatcggaacagtatatcagtatggattgcttcggcttatggtggatattgtatttaaggatgtcgagggtgtacctacgtataaatttgactttcctactatgcttatttctcttgcttgttttatcacgatttatgaaattatgatgtatatatattctgaaaaaattaagaagatttctatcaaggaaattatgattgagtaacaggggaaaatacatacaaacaatatggatacagtgccctgtctggtgaaaaaaactgaacaatgatactggaaaataccaaatttaaaagtttcatctgcattgtcagaagtgaaaaaatatagaataatagggacaaataaatctaaaagggttatttgtcccttatttatctttgaattaaatttctaaggaatcttccgcatctacccacatttgcatcgttccatcaagatacaatcttgcatattcaagtggttcatcaatagcaagtgcatttaatgcacaatctgatccaggtgttgtttttaaattcttttctgcttcccagcagtcaatgcggagcatatagccagcactggtatatacatcaatgctgtttctgtgtggattgtattctgcaaatatcgttctcatcgtatcaaatctccttatcgttcaatcaatcatttgttaaaaaaatagaagcatttcaatcagttcaccatgtcgttttaattttgtgttatactgttttataggattttcttgcccttgtatttgcccttatcagagttcgtaaacactggtgggacaatataatacaagggaaacaataagggaaagctcacctgcgataaacttagtgttttcaagggcttgagagatatttgataataaaatataacaattattaaattccttggaatacatgaaatctcaattctagtttgtataattgaaaaattaaaaacgcgtagacaactgtgtctattagtgaaaatacgatatttctcgctttgtgtcgtgttatttgcagataacagattctatatttgatgatgaaaggaggagttgaggtggaccaagtaaaaatcgggaattttttaaaaaaacttcgcaaagaaaaaggcattatacaggagcagttggcagaaatattaaatgtctctggaaggaccgtatccagatgggaaaccggaaacaatatgccggatatcagtattcttgtggatattgcagattattatgatatcagcattcctgagattatcagtggagaaaggaaaagcgagatgatgaacgaagaagaaagaaaaattgctaaaacaatgtcagattatgcaactacagagaaagagaagatttttaaggaaatgaagctccaaagtgtcatgggagtttgtgcattggttctatactggattctgcatgaaacaggtgcatatatgtataatgatgtgttaggaaagcttaccggttattgtgagaccttggtatctgtgtcagtcataatgatggcagcatttacgacaggatctttaagcaaggtgcggagcaagagtaggaaagtttttgtgttcgaaaatttcccaaaacctatgcaattagttgtaactgcagttgttgcttttggtggagctgctgtgatcaagctggtactggtgtattttttcggcttataagtattttcaaattcgtattacatactatggaaaaagaactttttgatattttcacagatgcgtgataatatgattatagaaaaagagtgctaccgatagacggttagtccgttttactatttagaatatctatcaaagataaccgcttagttttgcagacagggtgggaatttggcagagagaaaaagagccgggatctctgttttggcacgcagtgtacggaacagggaaagcctactgatgtctgggattgacagaatcagagaaataacctattataattacagagataaagatttttacatgggaagcttagccttcccatattttactttataggaaatgttcaataacagaaagttactctgcaatattttcctatattatgaaaaggatgaggtttgtataatgaaaaaagaaaaaggaaatgtcatcgctcttctgccaattggtgtatttctcatactgtatcttggtctgggaattttatttgaatatataatgaagattccgatgggattttataatgtaccgatcgtggttgcatttcttgctgcgattctggttgcctgtttgcagaacagagcagtaaattttgacaggaaactggaaatcatggcacatggtgttggggacaaaaacatcattacaatgcttttaatcttcctggcagcaggatcctttgttggtgtggttggaagaaatagtgcagaaagtgtagcatattttatgctgacactgataccggcaagattttctgtagcagttttatttgtggttgcctgttttgtctctgtagcgatggggacttctgttggaacgattacacttctggtaccaatcgcggcagctgtttccagtgcatcagattttgatcttgcattttgtgttgcatcggttatgggtggagcaatgtttggagataatctttctttcatttcggatacgacgattgcggcatgcaatggacagggctgtgagatgaaagataagttcagagaaaacttctggattgcatttccggcggctgttgcaactctggtcataatcctgattctgtcgtttcagacggagatccagggacatatcagtcaggattatcatttacttcaggtgttaccgtatgtattggtgctgattggcggtattatcggaatcaatgtttttgtggtgcttcttactggaattgtttccggagcaatcatcatgcttgcaggagggcatatcactccggtggaacttctgaccaatatgggatcaggcgtatcaggaatgtttgaaacctgtatggttgcgattctggtggcagcgatgtgtgccctgattcgtgaatacggtggttttgatgcacttcttaactggattcacaaaattttccacggaaagaagggtggccagcttggcatgggactccttgtcggtaccatggatattgcgactgcaaataatacggtagctatcgtcatggcaaatccgatcgccaaagagatggcacaggagtatggaatcacaccccaaaagactgcctccttactggatactttttcctgtatctttcagggaatcattccatatggtgcacagatgcttgtggcaatttctgcagtcaatgagttgggtggagaactttctgcttttcagatcataccgaagcttttttatccaatgtttcttctgcttgcatccattattactataataagaagtgattcatgatgcgcagcaggtgacagaatacgtgaatgaactaaaaacagaaattttcaaaaaacacttgaccttccaccttatggaagctgtataaaacagatacagacagggagttgaacgatttccggaactgtcgggaaagtaagaggtagcacgatgaaaatcaaacaggtggaagaacttgtgggaatcacaagaaagaatattcggttttatgaagatcagggactcctgaatgtggagcgtgcagaaaacggatacagggaatatcatcaggcggatgttatccggcttcaggagattaaattattccgcaagatggacatttccatagaagaaatgaaacttctcttcgaaaaaaagaaaagcctgcaaatctgtttggaacaacatctgaaagaactggatcatcgtaaagaaggtctttcgaagatgcaggatatgtgcgagcgactgatcctggaacaccggtcactggaatctctgaatgcagaggactgtctggaagaaatcgagcagatggagaaagaaggtgcaaagtttatgaacgtaaacaaaacggatgtccacaataagaaaagaaaaggagcaatcataggtgcagcagttatgacactgcttatgcttcttacgattataattatattctgggcaaacatacaggatccaattccgacaggattgtttttgctgttggagggaattccgatagtgatcattgtgggaacgctcatagcacttgcaggaagaatgaaagaaatcgaaggaggagaagaagatgaagcttctaagtattgaatatattccaggtgtggattttgagccactgggaatcgtaaaaggaactgttgtacagacaaaaaatgtcggcagagattttatggcaggtatgaaaacattggttggcggtgaaatcgtaggttacacagaaatgttgaatgaggcgagacagattgccacgaagcgtatggtagatgaagccaaagaaatggatgcagatgcggtgattggtgtaaagtatggatcttcacaggttatgtcaggagcagcagaagtgattgcttatggaacagcagtgaaatataaataaaaagattgtcagacagatataaaaaagaatacagaacagatcagagatctcacatcacagtcaaaggtgatgtgagatttttttctattgaatagtaatgtatataatgtttcgtaaggtatgggggatatcttagaaatatgatgaaaacatatgacaaaccatgtataataggaataatggatgaatcaaaagaaataaaaacggatgaggaatttaaatggaaggaaatttaacaaaaggtcctattttgaggacactgacgaagcttgcgattccaatcatggcatcgtcatttcttgggactttatataacattacagatatggcatggattgggctgttgggctcgaaggccgttgccggagttggtgtgggaggcatgtttacctggttttcacagggattggctgccatggctcgaatgggaggacaggtacaggttgcacaatgtatcggtcgtggtgaaaaagaaaaagcacatggttttgcgcaggcagcggtgcagttggctgcctttatggggatggcatatgcgcttctgtcgcttgtgtttacgaaacagatggtaggatttttccagcttgcagatgcagaggcacatgcagcggccatgtcctatacaaagattgcatgtgggttgattgtattttcctttatgacgctgacgcttacaggcctttatacagctcagggtgattcaaaaacaccgtttttggcgaatctgattggacttgtgacgaatatgatcctggatccggtcctgattctcggaccaggaccatttccgaagcttggggtgacaggtgcagcgattgcaacggtgacagcgcaggcaattgttatgagtattatggcccttgcagttatcatacggaaaaaagaaaatgtactgaaagggattcatcttttggctaaaatcccacgcgaataactgggaggaatctgcagaatcggaattccaacagctgttcagggaatggcgtactgtgcgatttccatggttctgacacgaatggtatcgggatatggcgcagaagcagttgcaacacagagagtcggcggtcagattgagtcaatttcctggaataccgcggatggttttgctgcagctttgaatgcgtttatcgcacagaattatggagcagggaaaatggaccgtgtaaaaaaaggttacagagcctctttatggacagtcggtatctggggaatattgatcacgctcgcatttgtctgtttcccgagaccaatcgcagagatctttttccatgaaccgaaagcaattacaacagcagtcggttacctgatcatcattggcttcagtgaagcattcatgtgtgtggaactcacaacggtcggagcattgtccggacttggaagaacaaaactttgcagtattatcagtattacattcaccagtgcgagaatcccgcttgcaatcattcttggaggtcttatgggactcagtggaatctggtgggctctctctgcaacatcgattgtcaaaggaatcatattcacctgtacatttttctggatcaccaggaagagaggacaaagcatatgaaaacagcaaaaaaaatttttaaaattgttggaatcattcttggaattatcatacttgcactgatcggatatatcatttatttatttgcaagttatcatcggattgaggacaatctgccacttgaggtggaatcccatgcggcagacgcggaacttacaacagaaaaagaatattccgcgcttacatataatatcggatttggtgcatatacaccggatttcagcttctttatggacggtggcaagttttcctgggcgaagagcaaagacagtgtgctaaaaacggttcagggggcaggagagctcgttgcttcttatgatccggactttgcgcttattgaggaagtggacttgaattccacgagaagctatcatgtaaacgaatactcaatcttgaaagaatgtctggcagattatgacacggtatttgcacagaactatgattcggcatttttgttctatccatttacccagccacatggtaagagcagatcaggtctggccctgttttccagatatccggtgacggattctttgagaagaagttttccggtatctacctcattcagtaaattctttgatctggaccgctgctacagtatttccagagttccggtcgataacggcaaagaacttgtgatctttgagctacatatgtctgcatatggaaacagcgatgcgattcgtgaaggacagatacgtatgctgtctgaggatatgcagaaagaatatgaagcaggaaattatgtgctttgtggtggtgatttcaaccatgatctgaaagcagcagaggatgactctacagataaagagtcctgggcataccctttcccgagagaagaacttccggaacattttgcgttctgcatagatcaactgaccgcgcaggaaaaaaatgacctttgggacagtgctcgtaatgcagatatggagtacgtgccgggagtgacttacaccgttacattggatggatttattatatctgataatatagaatgcgtttcttatgaggacatcaatacaggatattcttactccgaccacgatccggtatacttgaaattcagactgaaataaaatagcattcttataaaaataagaaggagagacatcagatgaaatttttgtttgcttctgattcatttaagggaactttgtcttctcccaaaacagcagaattacttacacaggcagcccgggagatattcccggactgtgtctgcgacagcatagaagtagcagatggcggagaaggaacaacagaagcagtactttcagcagtcaaaggaacaacaattcccttgaaagtgcacggacctttatgggaagaattgacatgcagctatggtatgctggatgaaaaacgggcagttatggaaatggctgcggcatctggccttccgctggttccggatgagaaacgggatccgagatatacaacttcttatggaacgggtgagatgatacgggatgctctggagagaggatttcgtgatatttccatagcgattggaggttctgctaccaatgatggtggaattggatgcatccgtgctctgggaggtcgttttctggatgaaaatggcgaagaactgaaaggctgtggaggagatctcattaaaataaaaaagattgatatatccggactgaatccgctgatcaaagaatgcagatttacagttatgtgtgatgtgaccaatccactttgtggtaaagacggtgcaacttatacatttggccggcaaaagggcgcaacacctgagattcaggatgaactggaaaaaggtatgtgtaactatcgtgatatcatacaaaagcaatttggcatggatatggataacgtaaaaggtgccggagctgccggtggacttggagcagctttgatggtatttttgaatggcacattgaaatcaggaattgaaacagtccttgatctgcttgactttgacagacgcctggaaggggtagatgtagtagttaccggagagggagctacagactggcagtccgtatttggaaaagtcatgcagggcgttggtatacactgcaaggcgcatggtataccggcggtggcaattgttggaagtatgggcaaaggggcagaagatatttttgaatatggaatagagtcgatgattacgactattaacggtgtcatgacacttccggaagcattggatcatgcggaagaattgtatcttggagcggccagacggctgtttcgtatgctgcgtgcaggaaggaaactctcagttgctgtgaacggagtgaacagtaacgactctcataagagggcagagtaattaatataggtttccttgaggttgtcaggcggttatggtatactgagtctagcaaaattttaatggggtttttatcaaaaagaggaggtttttacaatgagagaagtaaaagcgatcaagatcaacgtagcagattttgctccatatggaacattctgcaacatgacagagccggaaggctatccattacagggagaaatccataagttctatccggatcgtatttccggaactagtatgggaagtattgcattttctccaattgcagttcgcaaagatgagaggattatcaaagcagcggaatatcatacaacgacatgggaaggaattgtagcactggatgatgatatgatcattcatgtagcaccggcatccggcggtgtaccggttccggaacttgccaaagcatttatcgtaccgaagggatgcatggtcaagattaatgcagcaatctggcatctctgtccacttccgctgaataatgaggagcttcatgcaatgattattcttccggaatgcacctatgcgaatgactgtaccgtcgttgatttcgaagaaaaagactggttcaagattaccgtataagtataaaaatatatactaaaaactcctccagacgagctgtttccctaaagaaagcaaccggtatggaggagttttatttagcgtcagagcattttggggacattcaatattaaaagatcagatctgcaaatccggtagataccaggaacaggatcagcataacgatcggtaccacatatcgaatcataaagcgataaagaccggcacgtttgaagtgttcgccattgcgttctacttcgcctatgatccagtccggaccaattacccatccgatcagaatactggtcagaagagagataaacggcatcaggaaactgttactgatatagtccatgacatccagaagctgcccgacagatccatttggaagtttcagttcaaagtacagcttgttatatccaaggcagattactacagctgtgatcagagaatagataccgacagccccacacatttttttacgtggtttgtgataaagttccatgcagttggcaaccagagtttccataacggagacgcaggaggtaagtgcagcaaaccccatcatcagaaagaaagcaattgctacaggttgtcccagaacacccattgcatcaaatactttgggtaatgaaataaagataaggcttgggccggaagccatgccatctgtgccaagaaatacaaatacagccgggatgatcatcattcctgcaaggaaagcaacgccggtatcaaaaatttcgatctggtttgttgatttgttcagattgacttcattttttacataagaaccgtaggtgatcatgattcccatggaaacgcttaaggagaaaaaaagctggctcattgcatccagaagaatttccaggaaacgcttcacagtgagcccactgaaatctggctttacataaaaagcaagtccctccataccggtacggacagttccgtctgcatcggtatgtgtcagtgtcagtgagaaaatcgcgatgaccaggatcagaagaatcagtcctggcatgatgatcttggaaaatttttcgattcctttttcaacaccgcgatatacgatccatgcggtcagtgcaagaaagaccagcataaatatgatcggtgcaatatctgatgtgatgaaagctgtaaaatatccatcagtcgcagcatcttttccatcagatataatataggtaacaaagtatttcgtgatccagccaccaatgacagagtaataggtcatgatcagtgttggaactagaaatgtcagtttaccaagaaatttccatttcggattgagtgcttcaaaagccctgagcgcatttttcttggtttttcgaccgattgcaacatctgttgtcagtaatacaaatccgaaggtcagtaccagtaccagatagaccagcaggaataatccaccgccgtctttggcacagagatatgggaacctccagatatttccaacacctacggcacttccggcagcagccagaacgaagccgatcgatccggaaaaactacttcctttttccttcattttcaatttcccctctacataaagtttaattaagggccagaaaatacctgacccaatgtctttattttaacgcaaataagtatgtgtgtaaatggtagaaggagagagtttttttatatcagatgtgagatgactcccacctctgtaggtggtgagcaacaaaattatatcagtggtgggattcaatctcccatctgatatagcctccggcaggattgcaaagatgcacagaagaatatgtcatgcattgcatgacgtgcatctcgcagcaagaatgccgagggcattcttgaacaaaaatatggaaagagattctccggtacattcagtggaatcgtaaacaataattgtgaatacagacaatatatggcataataaatataatgttaattgtagatctttggaagaaaagcaggtgatcaagtggttaacaaagagtttttggtgaagcaagaatgtagaattcaaaagggagattccgactaaacgtgaaaagtttttgaaagatatcataaaaaagttaaaggataccacaatatgaatgacaagataaaagtcctttttctggacattgacaatacgcttctggactttgatgcggccgcagcctgggcaatggagcagtgctttcagaaagcgggactggaatataaatcagaaatgtttgctgcttttacagaggaaaataataagatctggcagcgtatcaaacgcaaagaactgacgatggacgacctgttttatgtgcgctggcaggcaattcttgggcatcttggactggaggcagacggtgttgaaatggaaaaagaattccgcgtacttcttaacttaagtgctgtaccagttgagggggcagaagaaattcttacatatttgaaacagcaaaagtactgtctgtgtgcggcaagcaatgggccatatgatcaacagattaatcgcctcaaaaaggcagatatgttgaaatattttgcacattgctttgtatctgagaaagtcggagcagataaaccaagtcaacgcttctttgatggttgtttgaaagaacttccgggagtacgaccggaggaatgtatgatgatcggagattccctgaccgcagatattaccggtggcagggcgtatggaatgtccacctgctggtatgtgccttctgtggaaaaatacagagaagaaaaagaaaaaagtggaaaaccagcggactacatcattcatgatttactggaattaaagaagattctgtagtagttcaaattgacatgagagcactgggagacttataatttatcagtcagaaaagttatctgagaatgaaagaattacatatagaaggtgaaaaatgtcaacatctatgacaaagggcagcccgctgaaactaatgcttcagtttgcactgccgctgttgatggggaatctccttcagcagacttataatattattgacgcggcaatcgtaggtcagattcttggcgctgatgcgcttgcaagtgttggatcgagcagcagtgtacagtttctggttttaggcttctgtattggatgctgtgccggttttggcgttcctgttgccagatattttggcgctggggatcatcgtactatgcgaaattacatatttaatggcgcggtacttacagcaattattgcggcaatccttatgattgcctgttcgttatcctgtggacagatcctgcatctgctttctgttccggatgatatttttggaaatgcgtatgtatatctgatcgtcatttttatcggaataccatttacactgctgtacaattatctgtccagcattctgcgttctgtaggcgatagccggacacctttcctgttcctggggttttcagcagtcctgaatattttcctggatctgttctgtattattgttttgaaatggggctgtatgggagctgcgatcgcaacgatcacagcacaggcgatcagtggaattctctgtttcttttatataagagggaagatgcagcttcttcgcctggagaaagaaaacatgatcgtgcaaaaggatgcggtaaaggaacttctgggcatgggacttccgatgggatttcagttctcgatcacagcaatcgggagtatggtcatgcaggcggcgaacaatggacttggaagtatttatgtttctgcttttacagcggctatgcgtattaagcagttccttctgtgtccatttgatgcgattggaacagcagcatctgtattctgcagtcagaaccttggcgcgcgtcaggcagacaggattaaaaagggtgcacttgaggcaacgatcgcaggatgcatttatggttttagtgccggtctgatactgatttttttcggaagaccactttcaatgattttcctgagtaaaaatgcgactgcagttctggatgcatctgcaaaatatctgcgctgtctgggattcttcttcggaattcttggaatcctcaatgtgtgcagaatggtgacgcaggggctgggatattccggaagagctattttctcaggtgttatggaaatgatcggacgagtaattgtaagtgttggatttgtaggaactatgggttatacagcaatctgttttgcagatcaggctgcatggatagcggccagttgttatattggaccgacctgcatctggtgtatccgccgttccattaaattactggaaggaaaacaggcataaaatcctgaaaaataaatgaggagtagatatgatcatgaaagattacaaagcagatgagggacttcagggcaatgataaaatagaaaaagcaattgccgggcttcaaaaagaaactacacaggagatgctggcgcatacacttaccgttatccgcagacgcatgaaagatgctggtcagcttatcattgctgtagaaccgcccagtggtgacggtcagcttcgcctggaagcagtcagaacagaagatggtaagaactggtgggttgcatttaccagttttgaagaggaactgaaaggcggcggaagcgtcaaatcaacgtttttgacggatatcgataaattatttgaactgactcttcagacagatgagattgaaggtgtgattctcaatccatggaaccgtaccattatgttggacaaatatctgattgagattattttgggaaaaactgcataaatttttctatatgacagatactatcatcgtattgcaaaatgaaagagaggaagcaggtacgatgatattaaaagaaaaagaacgcacaacgattgaagacttacagacacaggaaaaaagctgcattgagaaatatggcagatatgcacagcaggcaaaagatcctgagctgaaaaatctttttcagactttacagcaaaaagaacgtgaacattatgattctcttgactgtgtgctgagaggagaagttccgcagtgcaactgtaatgacagtgatggacgagattatcagccaaaggcaacttacacagcaatgagttcaccggaggataaacagcaggattcatttcttgcaacagattgtattgcgacggaaaagctggtgtcaggagaatataactcagaagtatttgcttttggcgacagcggtgtgcgcaagctgcttgcagatattcaggtagaagagcagaatcacgcagaaatgttatataaatacaaaatggccaataatatggcataaaaaagagagactatggctcaaaacaatgagtcacagtctctttttgtgtatggatattaaaaagatcagccctctgcataatattctttaaggaaaggaatggagaaagtttccattgcatccttaaggtcttctatatttctaggtccataaagcggcagacaggtgaaatcacggcaggtcagatagccgagaatcgcctgtgtaagtgaaatctgatattcttccatcagtccgtgaagtccttcggcaatcttgagattttctggtgtgtagtattcggaatttcttacagcatcagcaccgccggcatataatttgtggaaaaatccactggctacagacatatatggcatggccagattctgtggattttctatatgatattgctgcatttcttgatccatgatcttcaatgtatcgtcttcaagaggtttcatggaagcagaagcaatattaaacagagcttcatttgcgacaaaaccacggtatcctttggatgctgcataagcatcggcttctttcatacgtgcagtactccagttggagcatgcataatagcgaatcttaccttcttttcgaaattcttccataacttcaattagttcgctggcaggaatcgcctcattatctctgtgataaaaataaacatcaatataatcagtaccaagcgcgcggagagaaagttccagatcgtgacgcatattttctgctgaaatccgagaagcatgcatgtccggaacggcaggtgtcatatccggatgtccgcctttggagacaagaataatgtcatgacgtttcccgctttcgcgaagccactgtccaagtacacgttcactgcggccgatttcagaaggaatccagtcggcatatacgcgggcagtgtcataaacggttccgcccatatccagaaaagcatcaaaaattctgaaagcatcctctccatcccatttgataccggcatttacgcagcccattcccattggagaaagctcaaggtctgtgtttttaatcgttatttttttcatactatatccctttcctgttatgtgatacgaaaaagaatctgttacggtgtacatagcaatcttaatataagtttattataactatcttttagatacaggtcaaagttttttgaaaaatcatttttacaaagattttacacgcatgtgattatgcattttacttttctcccatataattgcaattgtcaatgagaaatacaaaaaattaaataaagcaaaataaagaggagatttatcattatgaagaaaaaagttttagcaatcgttacagcagcacttattggaacaaccgcattcgcagcaactgcaagcgcagcaagcggaaccattgatgttatatcccgtgaagacggatcaggaacaagaggagcattcattgaactgtttggaatcgaagagaaacagggagatgaaaaagtagatatgacaacagaagatgcaagcatcacaaacagcacatctgttatgatgacaacagtagctggtgatgagaatgcaatcggatacatctcacttggttctctgaatgatacagtaaaagcagttaagatcgatggtgctgaggcatcagcagaaaatgtagcaaacgatacatacaaagtatcccgtccattcaacatcattacaactgacaaactcagcgatgcagcacaggattttgaaaactacatcatgagtgcagatggacagcagatcgttgaagacaatggatacattaaagtagcagatgatgcaaaagcttacgagcagagcgatgcggaaggtaaagttgtagtagctggttcttcttctgtaacaccggttatggaaaaactgaaagaagcatatgagaaagcaaatggcggtaagatcactgtagaagtacagcagagcgattccacaacaggtatcacatccgcagcagaaggtatctgtgatatcggtatggcatcccgtgaactgaaagacgaagaaacaaaagaaaatcttacagctactgagattgcaagagatggtattgcagtagtagtaaacaatgacaatgacattgatgaactgacaagtgaccaggtaaaagcaatcttcacaggtgaaacaacagattgggaagaccttgcgaaataagtaagaccgatagatatagacttaagcaggaagcccggatttccgggcttcgtgtatgtctggtattgtatatcaaaagaaacaccagtggtgttatctgatgatgagtataagagaggaagagtcctgtatgaatagatttaaagaacaggccatgaaaattgtttttatggtggctgcctgtgcttcagtcttggcagtatttctgatatgtttgttcctttttgccaatggaatcccggcaattgccaaaattggaccgctgaaatttcttcttggaacggtatggaaaccgtctaatgacaaatttggaatttttccaatgatcattgccagtatttatgtaacaggtggagcgattctggttggagttccgatcgccttatttacttcagtatttatggctcgctattgtccgaaaaaaatctatcgtccactgaaatccggaattgagctgatggcaggtgttccttctatcgtatatggatttttcggactggtacttatggttccactgatcagaaacacatttggcggaaccggaaccagctggatggcggcatccctccttctgggaatcatgatcctgccgacgatcatcggacctacagaatctgcacttcgcagtgtatcggaaagttattatgaaggttcgcttgcactgggagcaacaaaagaaagaagtatttttgtggttatgcttccggcagcaaaatccggaattctggcagcagtcgttcttggtattggacgtgcgatcggtgaaaccatggcggtgatcatggtagccgggaaccaggcaagaatgccagccggactgctcaaaggtcttcgtaccatgactgcgaatatcgtaactgagatgggatatgcaacaggtcttcacagagaagcactgattgcaacaggagttgtacttttcgtattcatcctgatcatcaacctgagtctttctttactgaacaggaggtcagagaatgcaaactaacgcagcagtagcagaaccgatggtggaaaaaatgaaaaaaagaaatgaaacatcagcagcagatcgaattcggtcttatctgcgtcatccaggatcaggtgtacttgcacttcttacgattggtgcagcagttgttacgtttgcagtcctgattttcctggtggcttatattctggtgaaaggtattccatatctgacaccaagtttattcagcctggaatatacatcagagaatgtttctctgatgccatcactgatcaacacttttattatgacagctttgtcgctggtaattgcagcaccacttgggatctttgctgcgatctaccttgtagaatatgcaaaaaaaggaaataaactggtacaggtgattcgtattacagcagaaacactttccggtattccttcaatcgtatatggcctgtttggtatgctgttctttgtaacagcacttcattggggaatgtctcttctggcaggtgcatgtacacttgttatcatggttcttcctttgatcatgagaaccgctgaagaagcattaaaggcagttccggattcttacagagaagcaagtttcggacttggggccggtaagctgcgtacaatctttactatcgtacttccatcagcagttcctggaatcctggcaggaatcatccttgcaatcggacgtatcattggagaaacggcagcacttctctatacatcaggaacagttgctcaggtcccgaatctgatgggatccggccgtacactggctcttcatatgtatgtactttccagtgaaggtcttcatatgaatcaggcatctgctaccgcagttgtaattcttttatttgtattaattatcaacggtttgtctggtatggtggcaaaacgtatcgcgaaaggataacagaacatgagtgataatatcaaactttcaattgaagatatgaatcttttttacggaaattttcatgcactgcatgacatcaatatgcatattccagaaaaagagattaccgcttttatcggaccaagtggatgtggaaaatctacacttctgaagtctctgaaccgtatgaatgaccttgtagaaggctgtaagatcaccggtaaagtagaacttgacggagaagatatttatggagatatggacgtaaacgttcttcgaaaaagggtcggaatggtattccagaagccgaatccgttcccgatgagtatttacgataacgttgcgtacggaccgagaacacatggtatccgttccaaggcaaaactcgatgagattgtagaaaaatctctccgtgatgctgccatctgggatgaagtaaaagaccgattaaagaaaagtgcacttggtatgtctggcggacagcagcagaggctctgtattgcaagagctctcgcagtagagccggaagttcttctgatggatgagccgacctctgcacttgatccgatctcaacctccaagattgaagagcttgcaatggaattaaaaggaaaatatacgatcgtgatcgttacgcataatatgcagcaggcgactcgaatttctgataaaacagcgttcttccttctgggagaagttgtagaattcagcgatacagatactctgttttccatgccaaaagacaagagaacagaggactatattacagggaggtttggttgattatggcaacgcatttcgaacggcagcttgaagaacttcatgtacagatcattacaatgggaagcctctgtgaaaaggttatttcactttcgaacagagctatccgcggtgataaatgtatccaggaaatctttgatactgataaggaaatcgacacaaaagagcgcgagatcgagaacctctgtatgcgtattctgttgcatcagcagccggttgcaagagatctgagagaggtttctgcagcactgaaaatgatttcagatatggaaagaattggagatcaggcatcggatattgcggatctttccaagttcattgaggaaaatcatgtgcagattccggaactgatcggcaagatggcggagatgacagtcggcatggtgacagaaagcgtagatgcttttgtcaagagagatctggacctttgccgcaaagttattgatgacgatgatcaggtagatgatgcatttaatcggatcaaagaggagctggcagagcttatgtatcagaatctggatgcaaaagcaggccttgaccttcttatgactgcgaaatatatggaacgaatcggagatcacgcagtgaatattgcagaatgggttgagtatgcaattactggtgttcacagaaataatgaacatcaattaggaggtcattgatgtgacaaaaaagatttttaaatcaagcatactggtagctgcggctgtactgatttttgggattgcatgtgttatggcaatcctttatcagcattttggaaaacagatcaatactgagttgaaaaaagaagcaacttatctggtatatggtgtagaggagaatggtatagattatctgaaacagatcaaagaaaaagatgaccgtatcacctatattgcggaagacggaacggttctctatgataatcaggctgatgccgcaaccatggaaaatcatggagaccgtaaggagattcaggaagcactgaagacgggcagcggccatgcggaacgtacttccaaaaccctgtcgcagaaaactttgtactatgcattgcgactgtcggataatagtgtactcagggtatccagtacgcagtattctgtctgggtacttcttatggaactggtaccaccacttataggcattgctgttgtgatgctgattctggcagcaattatgtctgtgcatatggcaaataagatcgtggagccgatcaataatgtagatctggagcatccggaagaaaatcagatttatgaagaagtaggaccgcttctcagcaagatttacaaacagaaccgacagatcaagagtcagctggaagcagcccgacggaatcaggaagagtttggcattattacagaaaacatgcaggaaggtcttcttgttattgacagttacacaatgattctttcgggcaattccagcgcatggaagctgtttcagttaaaagatccaaagattggtgacagtgtgtactctctgaacaggaatgaagatttccgtcttttgatcgaacaggtactgaagggacaacatggaagtgttctgcttcatatgggaagtgaagccattcagatgattgcaaacccggtaaacagggaacacagagttgtgggtgcggtcatccttctgatgaatgaaacagagaaggttgagcgggaacagttacgcagagaattttctgcaaatgtatctcatgagctgaaaacacctctgacttctatttctggatttgcagagatcatccaggacggacttgtcaaagaagaggacatcaagaagtttgcgggcagaatttataacgaagcacagcgtctgatcacgctggtagaagatacgatcaaggtttcgcagctggatgagggtgaaaatccatatgaatgggagaagttggatgcgtatacaatagtgaaggatgtctgtggccgtctgagagaagttgcagagaagaagaatgtacatctctatatagatggtggcaaaacgatgcttgcgacggtgcatccaattttggatgaggtgatctataatctatgcgacaatggtatcaagtataataaagaggatggaacggtaagtattcatcttcgtgatctgggagaaaatgtggagattcgtgtcaaagacaatgggatcggtattccgggtgaagaccagagcagggtatttgaaagattttaccgtgtggataagagccattccaaggcaatcggcggaacaggactgggtctttctatcgttaaacacggtgtgaccttccttggcggtacactgaagatggtcagtgagattggcaaaggaaccgagatcacgatgacatttccgaaagaacgaaaggcagtttgaaagagcaaaaaagatgctgacatgcaaagcacgtcagcatcttttttgtcgttaataacaataggcgccttcatagctgttgcaggattctttcttatgggaaagatccttgcaggaactgcagtgatcacagaattcctgctcataacaggtggcgcagacacaattcccacagtggctgcggtcataggccggagtacaggtgtagggaagagcatcttttttcgctttttcttccatatacgattcacctctcctgaagttaccgttcgtttcgttcacagtaacttactgatacatttctgatactgatattatatcgctgtacctcgggagattcaagaaaataatgataaaaattatcaaattttcagaagaatttgaatactttatttcgcttcccagcggccggaagcaccgcatggaagtaccagcccattggaagttaccgggagtccgatttcctgggaatcgacatgtccgtcaaattctttcagctctgtagccagcatataagtcagcacagccggagcaagtcctgtagtataggagttgatcaggaaaaacagcggatttggacttaaaagcttcacacacagcttgatgagcggatgaattgcttcttcaatcttccagatctcaccttttggtccacgtccgtacgatggtggatccatgatgatcgcatcgtagtgatttccacggcggatctcacgttctacaaatttcacacaatcatctaccagccagcggattggtgcttcagaaagtctggatgcagctgcattttctttggcccaggtaaccatacccttggaagcgtctacgtgtgtaacctgtgcaccggcagcggcagcagccagagttgcaccgcctgtgtaagcaaaaagattcaggactttgatcgggcgtccggctttacgaattttatcaccgaaccagtcccagttgacagcctgctccgggaaaagaccagtgtgtttgaaactgaatggtttcagatgaaaagtaagatccttgtaatgaagatcccactgctgtgggagatcaaagaattcccattcgccgccgccctttttgcttctgtggtagtgagcattcatgtttttccatccacggcttatctttggggtgtcccagatcacctgtgggtccgggcgtaccagcgtgtattttccccagcgttcaagtttttcaccgcaggaagtgtcaattacttcgtattctttccagtcatttgcaatccacatatatgataacctttctttgataacctgatttgtatattctgcttatttagtataggtgaaagctcgaaattgtgcaagttttttatacgacggggacttgacaatcagtactttaccatactaaaatatacaggataatgatttagcataaaagctatatcagaaaatccattataagatgaatgaattttgccggacagtattctggaagcggcacgaggaggacgaacaatgcagaaatacagtgagatgagcaaagaacagcttcaggctgtcaagaaagagctggatcagcagtatgcagaaatcaaggcacagggacttgcccttgatatgtcacgtggtaaaccgtcagttgatcagctgaatatttccatggatatgatggatgttctgtcaagcagcacagacctgagatgtgagacaggcgttgactgtcgtaactatggtgtaatggatggtattccggaagctaaacgtcttctcggagaaatttctgaggttgatccggaacacattattatttatggaaactccagcctgaatgttatgtttgatactgtatcacgttccatgacccacggtgttatgggaaacactccatggtgcaagctggataaagtaaaatttctctgtccggttccaggatatgatcgtcactttaagatcacagagttcttcggaatcgaaatgatcaatgttccgatgtcaccggaaggaccggatatggatattgtagaaaaactggtaagtgaagatccggcgatcaaaggtatctggtgtgtaccgaaatattccaacccgcagggatacacatattccgaagagaccgttaagcgttttgcaaatctgaaaccggcagcaccggatttccgtatttactgggataatgcttacagtgtacatcatctttatgatgacgaaaaagaccaggatttccttcttgaaattttggatgaatgcgcaaaagccggaaatccggacatggtttataaatttacatctacatccaagatcagcttcccgggttctggtatcgcagctctggcagcatctaaggcaaacctggatgatatccgcaaatacattaccgtacagacgatcggacatgataaactgaatcagcttcgtcatgtaaaattcttcaaggatcttgaaggtgttcatgcacatatgagaaaacatgcagcaatccttcgtccaaagtttgaaatggtagaggctacccttgagaaggaacttggcggacttggaatcggagaatggacaacaccaaagggtggatattttatttccttcgaatccctggacggatgtgcaaaaaagatcgtagcaatggcaaaagaagccggcgttgttatgactggagcaggagctacctatccatatggaaaggatccgaaagacagcaatatccgtattgcaccatctttcccaccgattgaagagcttgaaaaagcggcacaggtatttgtcgtttgcgttaaacttgccagtgtagagaaattactggctgaataaaatttcatatttccgaatgttaaggaggcgccatggcggaaaataacaagagtatggacaaaggaagaaaactactgatcggttttattattgtactgctcctgcttaccgcaggcgcctacttttttggagtttattattttaccgagcattttcttcccggctcacaggtgaatggttttaactgttcttatatgacagagaaggaagcagagaacctgctggaacagaagacaggggtatatgcactggcagtacagaccagaggaaacggacaggaagcaatcacagcggatgaaattcaattgaaatatacatctgacggcagtgtaaataaattgcttcacaaacagaatcgttttagctggtttttagcattcagccagcaaatgacttatgagctgccttcttctgtgtcttatgatgaaagcctgtttgaacagaaaactgccagtttgaaatgtatgcaggacaatgtagagccggtggatgcgtatataaaggaaatcgatgatggatttgaagttgttccggaaattgaaggaacaaaaatagaccgtgataaactgatggaggacatcaaaaatgctgttactaccggcaggacagttgcaaatctggaagaagacggatgttacataaatccgaccgtgtatgcagatgatctgacaaaagactgccagcagatgaatgaacttacggatgttgtggttacgtatgatttcagcgaccgcaaggaaacagtagatcggtctgtgatcaaaaactggctgacaaaggacgaaaatgatgatctggtgctggataaggcggttattgcagattatatttcggagcttgcgaagaagtatgacactgtaggcacagaacgaactttttctacttatgacaatcaggaaattacggtatccggtggaaattatggctgggtgatcgaccaggaaaaagaaacagatgcattatatcaggatatcatggacaaaaagacagaagtacgggaacctgtttatgaacaggaagcgcagagccgtaatacaaatgatatcggatattcctatatagaaattgaccttacccgtcaaagaatggtattatatcagaatggatccccgattgtggatactggttttgcggcaagcagcagtacgccgacaggtgtttacagactgggtgacaagcaggaggctgcttctgtagatttctggatgccttttacagacaaacttggcatttatggagattccggtctggtcattacaggaacggatgtgtcagatgaaactggggattctggcgattttggaagctcagaggagagtgtggattttggctcctcagacagctggatgagtacagaaggctgtatagtgctgccggaagagcaggcgcagacaatttatcagaatgtagattctggattgccggtagttatatactgataccagggggaaaagatctgaatccatgtgagcttgctcacaagtggatgagttagaatattatgtgaggatgatgagaaaatgaaaattgttgtattagcaggtggaaccagcacagaaagggatgtttcaatcgtatctggaacaggaatctgcggagcgttgagacagaaaggacatcaggcgattctggtagatgttttctgtggtcaggaagaggtagactgggaagatccgttcccggcagaatatgatgtggaaaaagtagcagcttatatcagaggatttaatctgcagatggctgaactgaaaaaaacaagaaaaaatttctttggaccgaatgtcatcgatctttgtaaaaaagcagattttgttttcctgggacttcatggagccaacggggaggacggtaagctgcagggagcatttgatctgatgggtattccatataccggaaccggatatctgagcagtgccatggcaatggataaaggtgtgaccaaggcaatgttccagatgagaggtgttccgactccggcaggtaaggccatgaagaaaaaggaccgtgtggaaactccacaggagctgggaatggattttccggttgttgtcaagacatgctgcggtggttccagtatcggtgtctatattgttgataaccaggaagactacacgaaagcactggatggtgcattcacttatgaaaacgaagtagttgtagaggaatttgtagaaggtgttgaatacacagttgctgttgtggacggtaaggcatatccggtcgttcagatcgttccggtacagggcttctatgattatgaaaataaatacaaaccaggtgcagtaaaagaaacctgtccggcgccgatttcagaagaactgacaaaacgtcttcaggaagcagccgtggatggttatcatgcactggagatggagagctatgcccgtctggatttcattgtgacaaaagatgaaaaaatctactgtctggaggcaaatacgcttccgggaatgacaccgaccagcctgatcccgcaggaagcagcggttctgggtatggattatccgacactgtgtgaagaactgatcaaagtgtctcagaaaaagtatgcttaacagacgaatatgtacctgaattgaggtaacatatcaggagaggaaatcagaatgaaaaatcttactttgagaaatcttacaaaagtatgtaatggcatctggcatggcgacaatgctctgctggatcaggagatttctgcaattactacagacagccgcaagattgagaaagactgtctgtttgtgccaatcgtgggagagagagtcgatgcacaccgttttattccggatgtgatgacgaagggagcacttgcaacactttccgagcgagaactgccggaggctgactatgcatatattcaggtagaagcttctcttcaggcagttaaagatatcgcagagttttatctggaacagctgcagattccggttgtaggtattacgggaagcgttggaaagaccagcaccaaagaagtgatcgcatccgtcctgaaagaaaagtaccgcactctgaaaacacagggaaactttaataatgagctcggacttcctcttacagtattcagacttcgtgatgaagatcagattgcagttctggaaatgggaatcagtgattttggcgagatggcccggctgacaaagattgcaaaaccggatacctgtgtgatcacaaacatcggtacctgtcatctggagaatctgggagacagagacggagtcctgaaagcaaagacagagatattccagtctatgaagccgaatggacatatcgttctgaatggtgacgatgataaacttattacggtccgtgagtacaatggtgtgaagccggtattttttggcttgaacagtgaacgtgatgtgtatgccgatcaggttgaaagtaagggcctgaaaggggttgcctgccgtatccatctgggagaggatgcttttgacgtactcgttccgactccgggaatacatatggtctacaatgccctggcagctgcggctgtaggacgaatttatggtctgacgatcgaagagattaggagaggtattgaaagtcttgagacgattcgaggacgtttcaaaatgatcgagacagataagttcctggtcgtagatgactgctacaatgcgaatccgatgtccatgaaggcatctctggatgtgcttcatgatggggaaggccgcagagtggcgatccttggggacatgggagaacttggtgaagatgaagctgcacttcacgagggtgtaggcatacatgcagcaacatgtggaattgatgcatgtgtatgtgtaggagatctggctgttcatatagcagaagcggcgcgcaaagcgaatccggatttccctgtatattatgaaaaaacaagagaatcccttctggagcatctgaatgattatgtacagaaaggcgatacgattcttgtaaaagcttctcattttatgaaatttgaagaagtcgtaaaagcactggaagaaatgtaacggataatttaaaaaagaaaatttttacgcaggtgagccggaaaggtattacctgcgtaaatttttgtcagttaagaggggagttttgcgagaatttgacgaacgatttttgtttcatataggacggggcaggtgtagaataggcttaacggtaaatattgtattcaaggagggacttatgctggaacgaatcatggacctgcagatcctgctctatctgatgactgttcttggaacagctggagcgatagggatgctggcagtacaccttacttacagaagaaccctgcgaaagacaaaagcgacaacaaacctgagagaaaaatggctgaatctgtggaagacacgagataaactcctgaatcggatgaatttcctggtatggattccatcactgctatctactgtatgtctgggaatgtcgcttttttttatatccagaatccgtgacagcagaggacttccgatgagctatctgtatatagggactgccgtgccaattgttcttcttgtcctcaggcaggctctggattttagcttcaaagaagaactggttatgaattcacttgcggattatattctgcaggcgcgttcctgcaaagaaaacccaccggccgcccgtaaatacgaaccggtgcaggcagtacagaaaacagatccggtattcaaagaggaaatggtggagcggattgctgcaagtatccgacagactgcggcgacaggaagtcatttcagcaagatgctgagtccggaggaggaagaaatcatgagagaaatcatccgggagtttatggaataaccaggatatttcttgtagagtcgggaaggatttgttatactttcgatgtaaaaagtggtcactgtggaaatcgaaagtaaccaaaaaagattacgtaggagagaaaagggccggaagtatcagaccttttgtaaaaacgatatgaataaaaaaagagttatatggattgagctgcttcgtgtcatggcgtgtattggagttgttggcattcatgcaggctcacagcattttcgtgatatgccactggattcgtctgtatgggcggtttcaaacttttatcacgggatcaaccggtttgcagtagcatcttttattatgatcagtggatgtctgtatcttgacagtaagcggacatggaatctcagacgtttgtggaaaagaaatattctgccgatagctgcagcatatattttctggcagatgttttacgcagtatacaggattattacaaatggaacgctggcgaagggcagcaaagcagccctggtcaaatttatggtatatatcagtaaatcgtatttccatctctggtatcttccaatgctgatcggacttctgatcatcacaccgatgctatgggaaattgtaaacagtgccaggggaaaacagtgggaagagtatatgatcgtactgtttctggtgtttcagatcctgccatatacaataaattattttccacttccatggaaggaccatatcatggatattctgcagaccgtgcagccggaaatggttaccggttacataggatattttatactggggcattatctgtctcattatgaggtatcaaagaaactggaatatctggtttatgtactgggggtaatattgattttggcagcgatcggcttgtgttacatcagctcacagaaatcaggaaaaccaatacagtcattttatgagaactacacactggcaggatttttctggggaagttcgttttttctgtttttcaaaaaccatgtatccaagatcaaatggaatgaaaaacaggaaaagaggatctgctatctgggaagctgcacttttggaatctatctgatccatgcgcttatcagagatattcttcacagaataggaattgacagtatgatgataagtaatactgcaattgcgattccgcttctgatcacaatgatttttgtactaagtcttgctgcagttatgatcattaaaaagattccgcgagttagtaagtggatcatataagagtagatatgtaaataaaatagaatcattacttcacaataaaaaatctgccggggacaggagatgcctgaacttcggcagatttttttaatcttcttcgatcacttggatttcaagataatcaaactcgatatgttcaataaaactgtcctggcgaaatctggtctttgaatggcgtttgaaatcagaaatattactttccagccaaattgggttctccaggtcaaaatcatagcagatttcctgcagggcatgaaaaattttgtgtgttcttgtatcttccgagtcatcatcaatgaccagatcttttagcatgtggttgtctttccacatttttccccataaacgaaacataatgctgtacctcctgtaagaagtgattttatactgaatcagcaaaaacaatactttaagtatagctattctttatagagaagtaaagaaaatttattgcagattttagcgagataaagtataatagtattactgttcgcaggtagtatcccgcgagatgttttgccattattcatggcataaatcgcagagcggtagatgcgtgatttttatgaatggaggagttacaatgaagctttatgatagtggtatttatctggtaaatggccgtgatatcgtagaagaagagaacatgacacagccagtttccagagaagaagcagccagaaatacaatggcttatggtatcctggaagcacacaatacttccggaaatatgcagaaactgcagattaaatttgacaagctgacatctcatgatattacatttgtaggtattattcagacagcacgtgcttcaggacttgagaaattcccgattccatatgtactgaccaactgccacaattctctttgtgcagtaggtggaacgatcaacgaagatgatcatatgtttggacttacctgtgccaagaaatacggtggagtttatgtaccacctcatcaggcagtcatccatcagttcgcacgtgaaatgcttgccggtggcggtaagatgatccttggttccgacagtcatactcgttatggtgcacttggcaccatggcaatgggtgagggtggtggagagcttgttaaacagcttctttcccagacctatgatattaatatgccgggtgttgtagcaatctatctgaaaggggaaccgcgtccgggtgtaggaccacaggacattgcactggcaattatcggtaaagtatttgccaacggctatgtgaagaataaagttatggaatttgtaggacctggagtagccggtctgagtgcagatttccgtatcggtatcgatgtcatgacgacagagactacttgtctttcctctatctggcagacagatgagacgattgaagagttctatgagatccatggcagaaaagaagattataaagaactgaaaccaggtaaggtagcttactatgatggatgtgtagaagttgatttaagtgagatcaaacctatgatcgccatgccattccatccgagcaacacatataccattgatgaattgaaagcaaatctttatgatattctggatgatgttgagaaaaaagcgcagatcagcctggatggtaaagtaccttatacactgaaagacaaagtgatcgacggacagctttatgtggatcagggaatcattgcaggatgcgcgggcggtggatttgaaaatatctgcgcagcagcagatatccttcgtggtgcaagcattggagctgatgcatttacactcagtgtttatccggcaagtactccgatctatatggaacttgctagaaatggagtcctggcagatcttcttgaaacaggtgcggttgttaagactgcattctgcggaccatgttttggtgcaggagatacacctgcaaacaatgcgttcagcatccgtcataccaccagaaacttcccgaatcgtgaaggctccaaggtccagaatggacagatttcttctgttgcacttatggatgcaagatctatcgcagcaacagcagcaaacaaaggtttcctgacatccgcggaagaatttaccggaaattacagacatcagaaatacttctttgataagactatttatgagaatcgaatctttgacagcaagggtgttgcagatccaagtgtagaaatccagtttggcccgaatattaaagactggccggagatgccggcactggcagagaatctggtgcttaaagtggtatctgagattcatgatccggttactacgacagatgaactgattccgtccggagaaacttcttctttccgttccaatccacttggactggctgagtttactctttcccgtaaagatccggcttatgttggacgtgcaaaggaaattcagaaggcagagaaagctcttgaagcaggtgagtgcccggcagaagcggttccggaactgaaaccggttatggatgcgatcagggcacatttttctgatgtcagcaaggagaatatcggcatcggaagtacgatctttgcggtaaaacctggagatggttctgcacgtgagcaggctgcatcatgccagaaagttcttggtggatgggcaaatattgccaatgaatatgcaaccaaacgttatcgctccaatctgatcaactggggtatgcttccgttcctgattcctgcaggaaaccttccatttgcaaatggagattaccttttcttcccacaggttcgcaaggcagttgcagacaaagtagacagtattacaggatatgtagtaaaagcagatggactgaaggaatttcaggtaacacttggagaactgacggatgatgaacgtgagatcattctgaaaggttgtctgatcaattacaatagaagataagagaagataagataataaagacgacaggacctcatccatacaggtcagcaaataccattgcgcctgctatgtgatccatgcgcttatgatctgccagtcgctcgaactcgcttgcgctcagacagcgagcttggtggcagaagctaagcatgtatcacatgacgcagtgctcgtgagtatttgcagtcactgtatggatggggtcctgtctgtttattggtatggcaggatagtgtggatggtatggggaagggaatcaaagtgggagaaaaagatgaattatcagaaaattatatataatagataaaatatacaatataaataaaagatatataacaatataaaagaaaatataaagaaatatacaaaaatgtgttgacaaatatgagagccggtggtattataaactcatcaaaagaaaacaagaaaaaataaaatcaacaaacttaattaaaaaatcattcaattcatagcatatataaatgttacatgaaagggatgaaattataagaaaggtaaaggtgataccgttgggaaagtagtcaatcattttcaatatgagaagtggcagaaatcaagtttcctgcaagaaagacctgatacataaattatccattatttaaatcagattatcggaatacattcggaagagaatattaaatatattacctggtgaacaggactttcagaaaaaggataatctttataaacgtattacaggtatatagaattgattactcatattgaataactgtcacaaacctgatataaagatttttgaatctgtgtaaagaaacattttcaaatattgcgatccataaacgtgagttatatgaatcaaagctttacatcagaagaatatcttctcacaaaagatattaaacagaaataacagaaaccttattcccgaagaaaacagtttgaaatttaagaagttaagtttgaagctgctctagtctggcggaaaagatttcagagattatttcaaaatggaattataatccgtaaattataatttcgactctatgaactttctaaatgaatcgaatgataaacatcatatcgtttatgagcaggaaattaaatgaactgtaaccgaataaagacacgatataatatatataataaaaactgaatacagaagattgaaggaagtatactataagaggtatcagaggatttcaatcagcaaacaagacgaaaagttttgaaagaacaaagaggtaaattaaaattgaatattgaagattgttaagacggtcatcatttcaggattatgaaaagtaattgttaagagaagtgatgaccgtctgactgttgtataaaaaagttttttacgatatactctccatagaaagtgcgaaagcataaaagggagagctttttttatgtggaataataagaatagtatagaagatatgatcatatttgaggataaagacattctggtatgtcataaagctgcgggtattgcagttcaaaatgcacgaattggagctgcagatatggaaagttctttaaagaattatctggctttaaaaaatacggaaacagttccttatctgggagttgtgcacagactggatcaaccggttgaaggggttctggtatttgcaaagaataaaaaagcagcagctggtctgacgaggcagattacaacgggaaatattgtcaaagaatatctggcagtgacagataggatgtcggagaaacgccagggacgactggaagattatctgataaaaaatggaagaaccaatacttctgaagtagtaacatcaaagacgagcggagctaaaaaagcagttttagattatgaggttatacatcaaatttcagatgagaggacagagagcggaaaaagaatccttataaaaattcatttggaaaccggtcgtcatcatcagatacgtgtacagatggcgcatgcaggaatgccgcttcttggtgaccgtaaatataatccaggagagatatctcaattaccacttggattgtgttcctgtcatctgatatttcgtcatccgattaccggaaagaagatggagtttcaggtaactccgaatggagaaagttttgcaggtttcccaaatccgtgattttaaaactggtaaaattgccgtattttcctctaaaagatgaaaaaactatgaaatctatagacgcaaaaaagaaaatgtgtataatgtagaaagataacggtaacagagcgcatttgtataaaaatatattcagaaaagaggaaaatacgatgaaaaaagcagctgttgtggtgcttcttcttgcaggtgtggctgcagtggcaggagaagccggtataatggatggctttggtaattttgttgcggatgtgcaggcagaagatgaactgccggataacgagaaagctcaaaatgaatcagaagaagtaacaggtgaggaagaggacagtgcatccaagatagatacttccatcacaattgggacagggagcaggattgctgttgtaagcaaggctacagatggagaatactggaaacttgttcaccggggcatggaagatgctgtgaaggatatcaatacagcatatgatttttcttctgatgatgcagtcactatgacatttgaaggaccttccgatgaacaggatgtagaaacacagatcaatacgcttgatgcggtaattgcggagaatccaacggttctttgtatgtctgcaagtgacattgaatcctgtcaggcacagcttgaagcagcaagtgaaaacggaattccggtcgtagtattcgattctaatgttaatgaagatgaacttgtggcagcatttcgcggaaccgataatacatatgtaggaaagcttgccgcagaaaaactggcagacgctattggcgggtccggtaagattgcagtattttctgcccaggaaaagacagaaagttcccagaaacgagtggagggattcaaagaaacccttatggagtatccggatattacgatcgtaagtgaattgtatacagataaagtagatgatatggaaactgcaatggcagatgtacttaacagatatccggatctgagcggagtgttctgtacaaacgaagatgtttcagatctgtatcttagtcttgataagggagagaaggctccggttatggttggagttgatgcgacgactgttcagcagaaagcgattgcagatggacaggaacttggaacagtatcacaggatccatatgctataggatatcagacgatcattgcggctgcacaggcaatgtccacggatgttcagaaggctgcggaagtagaaaagaatgttcttcttgagccagaatggattgatgcatcaaatatcagcgatgagaccaacagtaattatctttattcaaaataatatatgataatggcaaaagggtgtcataaatagttttcaactccggcaaggacagttcacattgaactgtccttgtgttataatagataagattcgacgaaaatgtaatgaatcggatttagaatggaggaaatttttttgaaagaaagagaaacatttggctcaagacttggattcattctggtttctgcagggtgtgcagtaggtcttggaaacgtatggaaattcccatacatgacaggaaaatatggcggagctgcttttatcctgatctatcttgtctttctcgttctgcttggcctgccaattcttgtaagtgaatttgcagtaggacgaagcagcagactgagtacggcaagagcatttcacaaactggagccggagggttccaatttccataagtacagctatatgggaatgatcggtaattatatgctgatgatgttttataccatggtagcaggatggatgatgtactacggttatgttatggcgaccgggaaactgagcggagcttcttctgatgaagtgagtggctttttctcaaacctgatgacatctaccggaacaatgaccggctggatgatcgttgcagtccttcttgcctttggtgtttgttctttgggacttcagaatggaattgaacgtatcacaaaggttatgatgatctgtcttctggcactgatcgtggtgctggctgttcattctgtaacgctggacggagcgatggaaggtgttaaattttaccttgtaccaaacatcgacaatatccgtgcggcaggtcttggaaacgtgatctttggtgcgctgtcacaggcattctttactttgagtatcggtatcggtgcgatggagatcttcggaagctatatgggaaaggaatgtacccttgcaggagaaagtattaatatcctgatcctggatacatttgtagcactgatggctggtcttatcatcattccggcatgttttgcatttaacgtagagcctggtgcgggaccgggacttgtattcatcactttgccaaacgtattcaaccagatggcaggtggaagactctggggagctctgtttttcctgtttatgtcctttgcggcactgtctacggttattgcagtatttgagaacattctgtccttcgcaatggatctgtggggctggaaacgtaataaagcagttttatttaatatcgttctgctcattattctttccatgccggcaattcttggcttcggaccatggtccggaattcagatcctcggtgaaggaacaaatatcatggatctggaagattttattatttcaaataacatcctgccacttggttcagtaatctttgtaatcttctgtgcatctaagaatgggtggggatgggacaacttcattaaggaagccaatactggaaaaggaataaaattcccgacatgtatcagaaattacatgttgtgggtaattccggtcgttgtagcgattatttatctgaaaggttattatgatatgttccagccgaaaggaaatacttatctgattccatggatgatcgtgggcatcgcaatgctgatattggtaggatggatcgtattcggacacaataaaaagaaataagataccaggattatgcgagtgcacagcatggaataatcaacaggtatcgtaaacgacaaataattaagaggagacattattatgatagcagaaaaaatgaaaccttttgtacagaacaattcagcaattcgtatgatgttcgaagaaggaaatcgtctccgggcaaagtatggtgcagacaaagtctatgacttcagccttggtaacccaagtgttccagcaccggattgcgtacgcgaggcaatcatagatcttgtaaacaacgaagaaccgactgttctccacggatatatgagcaacgcaggctttgaggatgtcagagaaacgatcgcgcagtctctgaaccgccgtttcgggacagctttttctgcacataatctgatcatgacagttggtgctgccagcggtctgaatgtcatcctcaagacgatactgaatccgggcgaggaagtgatcgtttttgcaccgtactttctggaatacggtgcatatgtacgtaactatgacggtaagcttgtggaaatctctcctaatacagagactttccagccaaatctgaaagaactggaagagaagattacagccaatacccgtgcagtgatcgtaaatacgccacataacccgaccggtgttgtttattctgaggagacgattaaagaacttgctgcgatcctcgagaaaaaacagcaggagtttggttctgtgatctatctgatttcggatgaaccgtatagagaactggcttatgatggcgtagaagttccatacctgacgaaatattataagaatacggttgtaggatattcctacagcaaatctctgtctctgccgggagagcgtattggatatctggtcatcccggatgaactggaagacagcgcaacagtcatcacagcagcagcaattgcaaaccgtgtacttggaagtgttaatgcaccatcccttatgcagaaagtcatccagaaatgcgtagatgcagaagtggatgtggctgcttatgacagaaaccgtctggcactttacaatggccttaaagaatgtggatttgaatgtatcaaaccacagggcgcattttatctgtttgtgaaatctccggttgcagatgagaagcagttctgcgaggccggtaagaaatataatatcctgatggttccgggaagctcctttgcctgccctggatatgtaagactggcatattgtgtatcttacgagacgattcagaattctctgcctgaatttaagaagctggcagcagagtatgggctgtaggaagccggaatgtacagtacacgaatttgtaaaatgtataatagaaatttataagagtaaaaacagataaaaaagacgcaggagctgacttttttggtcatgcccctgcgtcttttgcagtgcatatcgaggaagcaccggtggtgcgctggtcagatcttgtcaatttttttacggatatccagcattttctgatcgagctgtgtgatcacagaagcacactgctgtaattcttcattgatcactgctgcctgcttttgtccgcgtttgtaacgcaattgatggtcgaggttggcccagtaatccatggcagcagttcgaagctgcaattctagtttgatccactggttttctttctggaatggaattgcaatttccagaatcagatgaaggctttgatagccggatttctttggctgctgtacataatctttgattttcaggatatggatatcctgttgtttttcgatcaggtcagccactttgtaaatatcatctacataagcacatacagcacgaacgccaatcaggtcattgatcttttccagtgccagatcaaaattcaggtccagtccttttttctgcatttttttgcagacactgtcatagcttttgagtctccatgttttcatctgaataaaatttcgtttatatttcatcagcagaaatgtgttgatgatgtcgagtttggtcatcataagattgatggcacattgtcctttaatgctaaattcgctgtcggtcagcatgctcttaagaagttctttctttttcaatttctgtctttcttcctctaattgtatcagtgtaaatgtttctgttgcccgtaatgcatttcccgttcccattagaatactcctccagtaataaatctgtacgtgatttgcgttaaatcaaagttaaacagtcgcgttgccagcgttagctggaatgcaacccgtgtgtgggaattttgatttggatttctgtttcccatcatttaatctatgaaaaggggtggagaaatatgacaggaaaaaatagaaaattttgttatgaaaatcacaatcttatgagtatgaaatcgaggaaacagactttgaaaacaggtgtatatcaaattttttgcctgggaattaagaggaatgatgaaaatacggattgtataaaatgctgattaatggcgaaaatgtaagaaataatttgtttgaaattttaacaaaatacagattgacaaatgattaacgaacccgtataataagcgcatatcaatcattgataaataattaacgttaataaattgacggaattgtttatcggactaaagaataaggctcatatcataacagaaaaacaggaggattcacaaatggcaaagaaagaaacccacatcccggcaatcattgatactccggaagcactggaagcaaagatcgctgcgatgaaagaagcacagaaacttttcgccacttatacacaggagcaggtagataaaatcttcaaagctgctgcaactgcagctgataaagcacgtatcccgcttgcaaaagctgctgttgaagaaactggaatgggtatcgttgaagataaggtcatcaaaaatcattatgcagcagaatatatctacaatgcgtataaaaacaccaaaacctgtggcgttcttgaagaagatccggtttatggaatcaagaagattgcggagccgatcggtctgatcgcggcagttattccaactacaaacccgacttccacagcaatctttaaaacgctgatcgcgttaaaaaccagaaatgcgatcatcatcagcccacatcctcgtgcaaaaggaagtacgattgaagctgcaagagttgttctggaagctgctgtaaaagcaggtgctccggaaggcattatcggatggatcgatgtaccgagccttgaacttacaaatcttgtaatgaaagaagctgacatcattcttgcaacaggtggtcctggaatggttaaagcggcatattcttccggaaaaccggcacttggagttggcgccggaaacacaccggttatcattgatgacactgcagatgttcgtctggcagtaaactctatcattcactccaaaacatttgataatggtatgatctgtgcatccgaacagtccgtaacagttctcgaaggtgtatataaagcagttaaagaagaatttcagtatagaggatgctacttcctgaagaaagatgagattgaaaaagtaagaaaaacaatcctgatcaatggtgcactgaatgccaagatcgttggacagaaagctgctacgattgcagagatggcaggcgttacagttccggcagaaaccaagatcctgatcggtgaagtagaatctgtagatatcagtgaagagtttgcacacgagaaactttctccggtacttgccatgtacaaggcaaaaacattcgacgaagcgatcgcaaaagcagaacagcttgtagctgacggtggatatggacatacctcttctctgtatatcaatgtgaatgagaaagaaaaaatggcaaaacatgcagcagcaatgaagacctgccgaatcctgatcaatactccatcttctcagggtggtatcggagatctttacaacttcaaactcgtaccatctctgacacttggctgtggttcctggggtggaaactctgtatctgaaaacgttggtgtgaaacatctgattaatatcaagactgttgctgagaggagagagaacatgctctggatgagaaccccggaaaaagtttacttcaaaaaaggctgcctgccggttgctctggatgagctgaaaaatgtgatgggcaagaaacgctgcttcatcgtaacagactccttcctgtacaagaatggatatacaaagaaaattgaagataaactggatgagatgggaattgttcatacatgcttctctgatgtagaacctgatccgtctctggcttctgcaaaagcaggtgcagcagcaatgcgtgcatttgagccggactgcatcattgcaatgggcggcggatctgcaatggatgccggtaagatcatgtgggttctttatgaaaatccagatgcagacttcgatgacatggcaatggatttcatggatatccgtaagagaatctacacattcccgaaaatgggtaaaaaagcttactttatcgctgtacctacatcttccggtacaggatctgaggtaacaccgtttgccatcattacagacaaagaaacaggaattaaatggccactggctgactatgaactgatgccggatatggcaatcgtggataccgacaacatgatgagtgcaccaaaaggactgacaagtgcttctggtatcgatgttatgacacatgcgatcgaagcatatgtttctatgatggcttctgactacacagacggacttgctctccgtgcgatcaaacttgtatttgattatctgccaagagcatacagagatggaaatgatgtagaagcaagagatcatatggcaaatgcatcctgcatggccggtatggcatttgcaaatgcattccttggagtaaaccattccttggctcacaaactgggtgctttccatcacatcccgcacggtatcgcaaatgctctggtcctgacagatgttatgcgttacaatgctgatgaagttccgaccaagatgggtactttcccgcagtatcagtatccaaagacactggcacgttatgcagagatcggacgttttgtaggactgacaggaaaagatgacaaagaagtatttgagaaacttctggataaactggaagaactcaagaagattattgagatcaaacctacgatcaaagattatggtgtagatgagaaatacttccttgagactctggatgagatgagtgaacaggcatttaatgaccagtgtaccggtgcaaacccgagatatccacttattgcagaactgaaagaaatctacctgaaagcatactatggtaaataataaattttagattggtgtgttttcttccataaaaatattataagcagtgattgccccggaattacaggaatgtaataccggggcaattgctttattagccatactattgtaagagaaatttagataaaattcagaatctgtgtattgcaagccgggggatatggatgttacaataagcactaatgacaatgttaacataaacagagagcttatataggagatatataaggaaaagaagctgatgcttcagggggcatgattattgaaacaaaatgaaaacacaaaatatgtaaaacttggtattacaggagcggcagttctggcatttggatttgctatcatgtatattctgaatcagagcaagaatattgcagcaggtattcagttggtatttaatattctgaaacctttcctgtatggtgcgttgattgcctatctgctggcaccgatctgtaaccggatggatgagcgtttcctgaaatggtttcccaaggcaacagaaaagcagaagaaaggtttgaaatttctatctattgcaattgcagttatttgtgcagtcacgattgtagttctgctgattctgctgattcttccgcaggtatgggacagcacagtgaagatcattaagatacttccggccagacttgcctattgtaaccgcatgattgatcagctgctcaaggatcagccggaattgcagacatattttaatcatttttcatcacaggtggagaatggtctgaatgatgttctgaaagcaaattccagtatgatgacaacgattcagggaattgtcaataatattacagtacagttgatcgaggttttaagcgtattcaaaaatatgtttcttggatttttgatcgcagtatatcttcttgcaagccgtaaactgtttggagcacaggcaaagcttcttctgtatggtatctttccgaataaatgggcgaagatcattgaagaagaagttcattatacagacaaaatgtttaacggtttctttgttggtaagatcatcgattctgcaattatcggtctgatctgctttgcgggaaccactttattgggattcgaatccgctgcatttatcagtgttgtgattggtgtgacgaatatcattccgtttttcggaccatttatcggagcaattccatgtgcattattactgcttctgggaagtaatccgtgggatgctttatacttcctgatttttatcgtgatacttcagcaggtggacggaaatatcatcggaccgaagatccttggtaatacaaccggagtttccagtttctgggtattattttccattctgttatttggaggtctgtggggactggttggtatggtgatcgcagtaccattgtttggggttatctatgatattatccgtaaactgacagcaagaggactgaaaagaaaccgacatgaagagatgatgcaggaatataatgaaaaatttcatgaagagcctgaagaaacagagacaactcaaaaggatacgttcagcaaaaaaattaatgcaaaaatcaatgagtacattgataagaatgtaaataacaaatagcatattgagtataaaaataagtcccatgagttttgactcatgggacttattttatgtaaaacaccttaaggtgtttatattaatgtttttatcactgcttacgaaatgctgcacgttttctttctctaggatccagaattctcttacggatacgaaggctttctggtgttacttccagaagttcgtcctgatcgatgaattcgattgcctgctcaaggctgagaactcttggcggtgtcagtttcagagcttcatccgcggaagaagaacgtgtattggtcagatgttttgtcttgcagacattcagctcgatgtcttcggctttaccattctgtccgatgaccataccactgtatactttttcgccaggaccaacgaagagtgttccacgatcctgcgctgagaacagaccatatgcaactgcttcaccggattcaaaggcaatcagggatccctgtttacgatactggaaatctcctttatatggtgcatatccgtcgaaagtagtattcaggataccggtacccttggtggaagtcagaaattcaccacggaatccgatcagtccacgggatggaatgtggaattccagacgaacagatccgtcacttgctgtgctcattccctgaagttcacctttacgctcgctcagtttctggataacagtaccggagaattcttccggaacatctacataagcgatttccattggctcaagtttcttaccacgttcgtccgtgtgatacagaacttccggtttacttactgcgaattcataaccttcacggcgcatgttctcaatcagtacggacagatgaagttcaccacgtccggaaactttgaagcactctgtagagtcagtatcttctacacgaaggctgacatcggtgttcagctcacggtacagacggtcacgaagatgacgggaggtgatgtatttaccctcctgtccggcgagcgggctgtcatttaccatgaagttcatggaaagagttggttcggaaatcttctggaaaggaattgcttccgggttgtcaccgccgcagagggtatcaccgatatggatatcttcgataccggagatcgctacgatagatccgatagatgcttcttttacttcgaccttgttcagaccatcaaactcataaagcttgctgatcttaacttttttacgtttgtcaaggtcgtggtggttcagaagtgtcagctcctggtttactgcaatttttccattttcaactttgccgacaccgatacgtccaacatattcgttgtaatcgatggtactgatcagtacctgtgtgtctgcgtccggatcaccttccggtgccgggatatatttcaggatggtttcaaacagcggagccatgttttccggtgtgtctgcaaggtcaagaactgcatgtcctgctttggcggatgcatacaggaacgggcagtcaagctgctcatcggatgcttcaaggtccatgagaagttccagaacttcatcaataacttcttccggacgggcttccggacggtcgatcttgttgatgcagacgatgacatgaaggtccagctccagagctttacggagaacgaatttagtctgtggcatagcaccttcaaaggcatctaccagaagaataacgccgtctaccatcttaagaacacgttctacttcaccaccgaagtctgcatggccaggggtatcaatgatattgatctttactcccttgtaatgtacagcagtgtttttggataaaatagtaattccacgctcacgttcaatgtcgttggagtccatgacacgttcctgaacttcctggttttcacggaatacaccgctttgtttaaggagctgatccaccagggtagttttgccgtgatcgacatgggcgatgatggcaacgttacgtacgtcttcgcgttttgtcttcataaaaatcgaaatcctttcttttttcttctatataaatgtgtaaaaactttttttcgtgatacgatattccagtttaccacatttttcgcagattacaaggagttacagaaatttttttaattttttggttctaaatcttcaggggtattcatagcttagtatagacaaaatacccaaagaggaaggagaacaacattatggcagacaaaatcattgaaaacaatcaggtatcgatcatggggaaaattgatacaggcttcacattcagtcatcaggtatttggtgaaggcttttataccatggagcttcttgtgcgcaggctgagtgattctgaggacaggattccggtcatggtttcagaaaggcttctggatataacgcaggattatacggggcagtatattgagatccatggacaattccggtcttataacaggcatgaagaaaaacataaccgtctggttctttctgtttttgcgagggaagtaaattttgttgaggagcaggacgaatcacttccggtcaatcagatcttcctggatggatttatctgtaagccgccggtctaccgaaaaacgccgcttggcagagaaattgcagatatgcttctggcagtgaaccgtccttacagtaaatctgattacataccatgtatctgctggggcagaaatgccagatatgcatcagcgtttactgttggaggtcatgtgcttctgtggggaagaattcagagccgtgaatatatgaagcggatcggtgagaatcagtcagagagaagaacagcatatgaggtgtctgtaagtaagctggaatatatagattagaaggggcaaagtagttcggtattgcttttttggcggaactgcggtaagataagaccaataatgcgataagcgagtcttagataacattaagaggaagtattatggaaaaagaattaacagaggtatactgcggaaacggcaaaggcaagactgcactggctatcggacagagtctccgtgtggctacccagggcaaaagcgtgatcgtgatccagtttctgaaaggaagagaccagcgttcgctggatttcctgcaggatgtggacaacctggattttaagatctttcgcttcgaaaagagagaatgctgctacgaagacctgacagaagaagaaaaggcagaggagaaatccaacattctgaacggactgaattttgcccgtaaagttgttgttactcaggaatgcgattttttggttcttgatgagattcttggacttcttgactgtggtatcataacagttgagggaatcgcagatatactgaaacacaaggatgaatctatgcatattgtcatgactggatggaatttcccggaggaattaagaccgtatgtagatgtgatcacaacgctgaacaccgaggaagttcatccattggatgccaacgaataatataaattacagaagaataaaaggaggagttaaaatggcaatttttaaaggtgcgggcgtcgcaattgttacccctatgtatgaagatggaaaggtgaattacgataaactggaagaactgctggaattccagatcgccaacagcacagatgccattattatctgtggaacaaccggtgagtcttctacaatgacacacggagaacatcttaaaacaattaaatttgcaattgataaagtaaataaacgtgtaccggttatcgcaggaacaggttctaactgtacagagacagcaatcatgatgtcaaaggaagctgcatcctacggagcagatgcattactggttgtaactccttattataataaagcaacacaaaagggacttatcgctcactatactgcaatcgcaaatgcagttcctgagactccgatcattatgtataatgtaccgagtcgtacaggatgtaacatccagccggcaaccgttgccacactggttaaaaatgttaagaacatcgtaggcctgaaagccgcaagcggagatctttctcagatcgcaaagacagtatctctggcaggtgctgatctggaactgtattccggaaatgatgatcaggttctgccgatcctttcacttggtgggcttggcgttatctctgtactttctaatgttgcaccgaaggaaacacatgatatggtcatgaaattcatggaaggtgacactgcaggtgctgctaagattcagatcgatgcgattccgctgatcaatgctctgttctgtgaagtcaatccgattccggttaagacagcactgaacctgatgggtatgaatgtaggacctcttcgtatgcctctttgtgaaatggaagaaagcaataaagaaaccctgaagaaagcactgcaggatttcggaattaagctggcataaaacaggtataggatacggaggaatactattatggtaaaaattatcatgcacggatgctgcggacatatgggacaggtgatttctgatcttgttgcaaaagatgccaatgcagagatcgtagcaggaattgatgtaacagataaaggaaatactacttatccggtatttaccaatattaaagaatgtcagacagaggcagatgtcctgatcgatttctcttctgcaaaggcagcagatgcattactggattactgcacagagcgtaaccttccggttgttctctgcacaacaggtctgtctgaagaacagcttgcaaaagttgaagagacagcaaaaaagattccggtactgaaatctgcaaacatgtcacttggtatcaacactctgatgaaactgatccaggaagctgcaaaggttcttgcaacagctggatttgatatggagattgttgagaaacatcatcatctgaaactggatgctccgagcggtacagcactggcacttgctgacagcctgaatgaagcgatggataatcagtatcactatgtgtatgacagaagccagaaacgtgagatgcgtgatgaaaaagaaatcggtatttctgcagtacgtggcggtacgatcgttggtgagcatgaagtgatctttgccggcgaagacgaagtgattgaatttaagcataccgcttattcaaaagccatcttcggtaaaggtgcaattgaagcggctaaattcctggctggtaaaccggccggaaaatacgatatggctgatgtgatcgaaggctgatcgtagttttgtattaatattgaaattctggcaggcatgtatcgaaagatatgtgcctgtttttttacattattttgcataggaatctgccagattgtacatattatcattacaagtttaaatccatagtaaaggagaaattagaatgaaaaaaatacgcacaattctgacaggaatcctcctgatcctgacgttgagcatctttactgcctgcggaaataacaatgcaccggcagatgaggcaggaacagctacagaagaaaacacgaccgatacagggacgaatgaaaatgcagatgctgtgaatgataaaaaagacaatgaaaatacggataattcaaataataaagtaacggacaacgaaggtgtagcagacgatgctacaatcgataacggtgataccatgtccgagggaacagacaatgataatgtgcccaataatacagaagatggaagtgtgacgcaggatcttggtgatggtgtccgtgatattggcgatggagttggcaacgcagtagaagatgtcggtgatgcggtcggagatgtcattgatggagatgccgagacacgataacggttactgttcaccccgttcaccgcaaccaatgattcgatttattcgtttagcacaataaagtgcttgcatcagatgaaaaatcatattatcatagcatcagataaacctgatgatttatagtacaggcttcggattcaggaaatccggggcctttttgaaaggaaaatacagatgaaatttcgaccatgcattgacatacataatggaaaagtaaaacagatcgtaggcggaagcctcaaagatgccggagatcaggcaagagagaattttgtgtccggtcaggatgcagccttttatgctgagctgtataaaaatgccggattaaaggacggacatgttatccttttgaacggaaaagattcagagtattacgaggcgaccagaaatcaggcacttaaggcactggcagcttatccgggaggcttacagatcggcggtggtgtctgcccggataatgcggaagattatctgaaagcaggggcaagtcatgtaattgttacttcctacgtctttaaagacggacagctttcctggaaaaatctaaaaaaaatagaagaaattgcaggaaaagagcatctggtcctggacttaagctgccgtaaaaaagacgatcagtattttattgtgacagatcgttggcagaaatttacaaatgtaccggtgacaatcgaagtaatggaagaactgggaaatcattgtgatgaattccttgtgcatgcggtagatgtcgagggaaaggcaaatggaattgaaacagaactggcggacctgctttctgactatacacagcgaccggtgacttatgcgggaggtgtcggaagcatggaagatctgaaacttctgaaaaagcatggaaaagatcgtttggatgttaccgttggcagcgcgttggatctttttggaggaacgattccgtttgaaacactaaaaaatctggatgatctgcatatatgacagggggaaattcttgacgaaaaagttttctgattatatgatgtaggcaggaatatgggtggtgagaacacccactaaataaatgatcacagggaggtatttatcatgagtgaagtacttgacaaaatcaaaagcagaagaagtatccgtaaatacaggagtgatatgattccacaggataagctggagaagatcatcgaagcaggaacttatgcagcaacaggaatgggaaaacagtctccgatcatcattgctgtaacgaacaaagaacttcgtgataagctttctgcaatgaatgcaaagattatgggtgttgataatatggatccattttatggagcaccggttgttctgatcgtgctggctgataagagcagaccaacatgtgtctatgacggaagtcttgttatgggaaatctgatgctggaagcagaagagcagggaatcggaagctgctggatccacagagcaaaagaagaatttgaaagtgaagaaggaaaagaaatcctgaaatcccttggaatcgaaggtgattatgaagggatcggacactgcattctgggttatgcggacggtccggcaccgaaggctgcaccaagaaaagattcctatgtatatcatatagattaaacgtagtaataatattgcttaaataatgggttggtggggaaatttccccactgaccattttttgtccattgaaaatagaaagtttatctgaatataatgtagaaagataaaaaaaatattgccagagatggaggaaataccaatgaacaagattaaacatgcagcagctaagaaggttttcgcaggagtaatggattatgctgttgatcaggtgaataagaatcctgagacagcttatgagaaaattatcgacactgctgagaagtatttaaaagattttggaaagggtgtgaactgggattatctcaggaaagttgcctgtaatccggaatatacactgaatcgttatataacttccatggtacaggaactccatcctaatgttctgaagacaactctgatgaatcttggatttgaggctttctataatggaacaaaaacaattcatgagatgcgagaaatacataaatgtaatatcccgtggatcattctgatggatcctaccagtgcatgtaacctgcattgtacaggatgctgggcagcagaatacggaaacaagctgaacctgtcctttgacgatatggattcaatcgttacacagggtaaagaactgggagtttatttctatatgatgactggtggagagccgatggtaagaaagaaagacatcatcgaactctgcagaaaacataatgactgtgtattctttgcatatacaaatggaacactggttgatgaagcactctgcaaacagatgcaggaagttggaaacctgtttcttgccttaagcgttgagggtgagccggatgttaacgatatgcgtcgtggagaaggtgtgtacaacaaggttatgcatgccatggatctgctgaaagagcatggacttgtatttggtacatcaatctgctatacaagtgccaactataagagcgttaccagtgatgagtttattaagatgcttgttgataagggttgccgttatgctctgtacttccattacatgccggttggaaatgcagcatctgttgatctgctgctgaatccggaacagcgtgtttatgtgaagaaccgtgtaagagagatccgtaacatggaacatggccctggaatcttcactatggacttccagaatgatggagaatttgttggtggatgtatcgccggaggaagaaactacttccacatcaatgcaaatggtgatgcagaaccttgtgtatttatccattattccaatggtaacattcatgagaatacaatccttgagattctgaaacagccgttattcatggcttaccataacaaccagccgtttaacgataacatgcttcgtccatgcccgatgcttgagaatccagagatcctgcagcgtatcgtaaaagaaagtggtgcacattcaacagatctgcagtctcaggagacagcagaacatctttgcagtaagtgtgttcattatgccgaggagtgggctccggttgcggataaactgtgggctgaggagcataaggagtaaaaaaattcataacattaaaaacgtcattcctgcatctgtatttcagacaattcagaaattcagaagtactagcagaataaaataatataaaaagcaccccgaaaaatgatgaactcgcaaagctcagacagcatcatttttcggggtaaaatattattttcttcttaagtacttctacaaatttcttcaggcgtctgaatagcagatgcaggaaggacgtttttttattctgaagtttttatatgggcagggaaagaaccgggagactattgagattaagaaagctaaaggcacaacgggattggtgatagaagcttaatggggaaaggttagggtttatttttgcaggggtttgtattagaataggggtattggcaggaatgtagttttaggaattggagagtatttatgaaggttgttattttagctggtggttttggtacgaggatcagtgaggagagtcatcttaagccaaagccaatgatcgagatcggggagaagccgattttgtggcatattatgaagatgtattcttcttatggttttaatgagtttgtgatctgctgtggatataagcagcatgtgatcaaggagtggtttgcggattattatctccacaatagtaatatcacttttgactttacgcaggagaataagatgatcgtgcacaataatgtgctggagccatggaaggttacgcttgttgatacggggctgaatacgatgacaggtggtcgtatcaagcgtgtgaaggagtatctggatggggatactttcatgcttacttatggtgatggagtggctgatgtgaatcttgcagaacttctggaatatcaccgctcccatggtaaaatggcgacgattacagcagcacagccgggaggacgatttggtatcctggatattcagaatgatggaacgatcacgaattttaaagagaagaaaaaagaagacggaggctggatcaatgccggatttatggtgctggagccgtccattattgatctgatcgaaggagaccagactgtatttgaaaaagaaccgctcgtggaggcagcccgcatgggacagctgaatgcatatcgccacaaaggattctggcagtgtatggatactctgcgtgaaaagaatcttctggaggcattgtggcagagtggacaggctccatggaagatttgggaataaacagaatcggtcagaaaacaatctggtgtaaaataaatctgttggaggaattgttttgagtgcaacaagctgtgattactgtgcaaattatgtatatgatgaagaaagtgaaagctattactgcgatgtgaatctggatgaggatgaatactaccgctttatcagtacagaatataaagaatgtccgtattatcgtaatggggatgagtacattgtggtgaggcatcaattataatttacaggtagtattccgcgaggtgttttgccatgaatatggcaaaatcccgagacatacggggcaaaatgccatcaccgaaggtgatttggaatgcattttgaccaacgactgtgaacgaagtgaacagttgtagtgagacaccagatgtaaaaattacgaaagtcagtaattaagggatcggagaaaaacatgattacagtagagctggataatttcagcctgagagaaatctgccggtcgggacagtgcttccgtatgcacgagacggcagaaaataacacatatgaactggttgccggggataaatatctgaaaatatctcaggcaggaagcattgtaaatttttattgcagtgatgtagaatttatctgttattgggtaccgtattttgatattgattcggactatggacgctatattgaaaaggtgaatccgagggacacgtatctgagtgcggcggtacagtgcggaaatgggatccgtattctgcgacaggatctttgggaaatgatcattacttttttgatctcgcagcagaataatatttccagaatccggagctgtatcgagaggctttgtgtcagatatggtgagaaactgaaagcaggagataccgaatattattcctttccgacaccgcagcagttgtccgtggcgacagaagaagaactgcggaggcttggaatgggataccgtgccagatatatcgtggagacaacgcgaagcattctggcgggagaagtttcactggaaaaactgtatcagatgaagtattaccgcagagcacgaaaagaactgatgaagctcagtggagtaggcgaaaaagtagcagactgcatttgtctgtttgcattgcatcacatggatgcattcccgatcgatacgcatatccggcaggttcttgacgaacattatcgcagaggttttccgaacaggagatatcatggcatgagaggcattatgcagcaatatattttttattatgaactgatcggagagagagggaagatatgaagtattttgtaaatgtgctggtggatgttcttggagcagtctatcaggcagcaggcgcatcgctgcttatcgcggttctgatcatgtgtgtctatatgctgggaaggaagcagggtgttggaccggtagccagagcgtggatctggcagtttaaagaaagcagctggtttcgcagacactttttccttgtgttttatacctgcatgctgctttttcgtacgttattctgtcggagcgtctggggaaatccgctggaaaacgtgatcggaatctggggactgcattataacggacagctgtatacggagaattttgagaatctgatactgtttatgccgtttattatttttcttttctgggcgagagaagaaaaagatcacacaaaggataaaagaattcaggaagtattgttgaacagttttgaaatcagtttctgcttttcacttggaattgaaacctgccagctttttttgaaaattggaacgtttcagctgacagatcttttctttaatacgcttggcggaatgctcggtggagtgatctactggggatttgagagaaccagaaaaagaattgttttcggcgtgaagagaataggcggttgggatgttatcccgtggaaaaatgtcgcacagaaagaagcagatgtggaaaacactgcggaaactgttacagtcgtagagggaagccttccggaagaggcgattgcgccggaatgttcggaaccaagatatgctgcaatcgagaaactggtaagagaagccggacagaaaatgctgaaggcgagaccgggtgaggaaaatatccataaaaaagagggacttgcaaatttctgtacagattatgatacggcaatccagggatttctgatcaaaggtctgggtgagattcttccgggagctgctttcttcggggaagaagacacggaaggaaacgctggtgctgatgcagagggtgaatttactttctacatagatccgatcgatggaactacgaactttatgtttgattatcatcacagctgtgtgtcggttggtctggcccatggagagcagatgatcgccggatttgtatatcatccatatgtggacgatatgtatgtggctgtgcgaggacacggaagttatctgaatggaaagagacttcagatggctgataaaccggtggaagagggaatcgtggaatttggctgtgcgagatacaatgaagcaggaatcgactggctgttccgcgtggtgaaagaaatgtttcagaacagtctttctatccgctgcggtgggtctgcagcactgggactctgccgaggagcatccggaagtaacaccgtttatctggaactgaaactgcagccgtatgattatgcggcagcatcggtgatcctggaggaagccggcggcaggatcacacagatcgatggcagcccgattacattacatgaaggctgctcaattattggaggaacacctgcggcatggcaggagagcaaagatgcctttgaaaaattaaaagaagagatgtagatcagaaccgacaagattctaaaaatcagtaaaaaagcattgtgtggttgaaaaactgcatagtgcttttttgttacagaaaagttaaataaagataacaagtgtattttgtgctatttctttaatgaaaatgattttcattaagctatttaatgagaaaaaaagttgatttatggttagaaaatgctaacatttttgtggacatgaaaaaagagttatggtataaaaataaatggttagaaaacgctaacgcaatggtgtataaataaagaggaggaaggaaatggcaaatcagagattgatgaaaaaagttgcaccagttgttttgagtgcagcggtcgtaatgacaagtatgccggcaacagcttttgcagcagatttttctgatacagaagttactgtagcagaggaaagtgctgatattgaagaagcaagtgcagaagctgcggacacagatgttgtggaagatacagaggatacagatgtagacgttgaagaagcagcagaggacgtgacagaggatgaagaaacatctgatgaagaacttttcagcgcagaggtcagtgaagatgaatttgctgatgaggttggagatggacagacagaaggcgaagcatatgtcctcatgaacattccttatgacgatttttataaggcagaattaaagaataatgatgtgaaagttgatacattcacatctgcaacaaaacagaagacaagatccagtcttgcaaaaggctcttatcacgtaaattcagatggaagcgatatcactggtgtgacttttcctgtgaaagtatctgatatttcagtattgaaggacaaaaaacagattaaagataacgcttcagtgagtatcacaacagctataaagggaaaagaaactactacagaatacaaaggaaaagatgctctttttgaaagcgactcatattcctattatgttctttctgaggaaccatcctactacaaagaactgacagtcggtgaagatggaagttttacattcagtgccattgaaggtgaatcagcagtaccggagacaaaacaggtgcaggctgaattcaaaacaaaatccaactatggtgactaccagctgaagtttgataagactgaattcaacagcattattaatacagatactgacacagtgtatggtgcagttattaatacaacagacgaaacaacctatggtctctgccatctggaaaatatctggaaaggatatgagttggcatggagtacaggatatacaacagaaagtcatggatgccatctcaactctgaacattttgagtctatgatgggaaagacaattgacagcgtaacatattatacaagtaatggcatttatacattagatattgcagacgtaaaggttctggccaaaactggtgtgacagcgactgttgcagatatccatacaactgatacagaagcagcggttactctggacggaactcttccagaaggattttcagcaaaatatactgttgacgaaacagaagttgcttatgcagacggcaagattacaacaggagcactggcggcaggttcccatacactgacgatcagtgacgctaatggtgtatatgctccgattcaggcttccttctatgcaaaagaggcaaatgtaccggctgtatatgatgcgacagaacataaaatcgcagcagctgacggaattactgaagaccagttaaaagcatatattaaaacaattacttctgtaacagtgggagataagacttatgcagcttcaggaaaaggtgcaacagtgattgtcaaggaagatggaacactggatacctctaaactggaattggcagaaggtacaaaatttgtagtaacatccagttcatatgatgatcttgaattctcttacagcctttacagttatgtatatgcaggactcacctggggtgaatactggagtcaggagagtgtgaccgcagcaggaaacgtaagcggatctgacgaaaaagattctcataatgaatctgatacaggcgcatttgatgcagtaacaagagctacaacaaatcatggccttcacagaggaagctatcagtgcatggctacaatttatacaacagaaggcaatgcatatcagttatcttactggaagagcagtacagaaccggttcttgcagatggaacagttgcaatctggactccggcagacagaaagactggtgcgccggcatctattcaggtaaatggcggagcgaaagaaagccttgatcattatgcagtaacaggtattaaatatgttcctgtacaggtaaaagctggagattatgcagattttgcagcaaaatatccggtagtaaaaaatggtgaaacacttgtcggtggtttctcggaaaacaatctgaaagcatacagcgagactgcaaatgtaacagtaaacacaaatggactgaaatcagcaactgagaatgaagatggaaccttctctttcagtgcaagaaaaacaggaacagaatccggtattcagggaactgatctcaaagttgcaactggaattaagccagaggttaaaacagcaagtggatcttatggagaattccttcgtgtggatctgaatggtaattatggcggtcttggtgctgcaatgcaggcagttaaatgggattattatggaaatggtaatacagtacttgcaacatatggtacgaaatttgctgctgataactggatgcataaattgatgggaattcagcttggtctgacacattctgtaagatgccagcttccggcaggaacagatggaacaggtcactggaaattgactgtttatgcactgggatatcaggactatacatttgagtttgatgcaacagctaccaatattgtgactccaacagatccgtccacaattgatacaacagcactgaaagcagcacttgaaaaagtaaaagctctcaataaggatgattatacagaggaatcctggaagaaagtagaagatgaagctactgaaacacaggaaatgctggaagaaattgaggcagcaattaaggataagacaacagttgcattcagccaggctgcagtagatgagcaggttaatgagcatctgacagcagcaatcaatggacttgtgaagaaagaaaaaccggtagagccagtagtgacaccagatgttaaaccaacagtaacaccaggtaaaaatgaaaccaagccaactgcaactccaacaccagtggttaagcctggtatcactgcaaaagtttcacaggtttatgtcggaaagaaagctacaatcaaagttaccaaaactaaggtaactggaaaggttactttcaaatccagcaataagaaagttgcaacagtcaacagtaagggtgttatcacaggtaagaaagctggaaaagctgttattactgtaaaagttggtaaatacaccaagaaattaactgttaaagttaagaaaccttccttcaagcttgtaaaatcttctgtaaagctcaaaaaaggtaacaaaacaacgattagagtaaaagcagcaccggtatctaaagttacatacaaaaccagcaacaagaaagttgcaacagttaacagcaaaggtgttgtaacagctaagaagaaaggaacagcaaagattactgttaaatgcaatggaattacaaggacattcaaagtaacagtaaaataattcctttataaaatacacatacaaaagaacgggggccgtttataactgccccttcttttgtatgttaaggggtagattatatgtacaaaaagaatcttatgaaacttcttccggcagttgctgtaattattgcgatcgcagcagctggatttcagcaggacagtgaagtgaaaagtacaaaaacagttcaggcagctgagaatgaactgataaaatcagatgaacttacgagtctgctgacaactgtatattttaatgacggaggaatgaaggatacggatgaggcagacagcagcattctgaaaacaaagaaaagtaaatccaaaataaaaaaagcgggaattacgacaggaaaaacaaaagcacttccggaaaagttagcagcagcttccgggcaggggcagggaacgaccacgacacctacaacttctgttccaaagggcggatataaagatgggatttatcagggaagtggaactggatttggtggaacgatcactgttcaggtaacgatttccggaggaaagattgcttctatagaaatactgagtgctgctggtgaaacaggctcttattttgcatcagccaaaggcgtgatcagcaagatgatctccggtcagactccaaatgtcgatgcagtaagcggcgcaacctattcctcaaatggaatcatccaggcagttcagaatgcactgtcaaaggccggaaaaggaaaagctgcaaagacaacgaaaaagacgaccaagaagaataccaatacttcaaataaaacaacaacgccggttgaaattacaaaaccgtccggagaggtaacttataaagatggaatgtatactgcagaagcagaaggatttgacggtccagtaaaagtcactgttacgattaaagacggaaagataaccgcaatcacaaatacgaacactgatacaaaagaatattttaataaagcatggaatagtattcagccaaagattctcgaaaaacaggcagtgtatggcgtggacaccgtaagcggagcaacgttttcttcaaatggtattcttaaggcggtacagaaagcgctggaacaggcttcggtaaatgtgacaccggcaccagaagtgacggtaagtccaactccggcaccgacaaccgctccagcaccggttataccggacacaccgaaggttttatataatgacggaacgtatacgggtactggaattggatatggtggaaagataaatatcagtgtaacaattaaagatggaataattacggaagtatctcagaccaatgaaggagaaacaccaagatatttcagaaatgcatggaatgtaatacagccggcaattattgcaaaacaaagcacagatggcattgatactgtatcaggagcaacatattcttctgagggaattctatatggagcaaaatcagctttagagcaggctttaaaaacttcagatataacagcgacaccaactccgaatccaacagcaacaccggaaccaacggcaacaccggaaccaacagcaacaccggaaccaacggcagcaccggaaccaacggcagcaccagagccaacaacagcacctggagccgggtataaagatggaagttatacgggaacaggagaaggattcaatggtcaggtaactgttacgattaatgtgtcagggggaaatattgtgtcagccggatatgatggagaagatgatgaaccggaattttccaatgcatggaatggaatttataatcaggttttaggtcgtcagtcagctgatgggctggatacagtaagtggagctacgtattcttcaaatggactgattcaggcatttcagagtgctatcagccaggcaaaataataaatgttcgatagtgaaaaagaaaacttgaaaacataaggagtttgaaaggaaaactttagatgaaataccagaattttattatgagaattttgtgtcttctgttgattcttgccgctgtagtaggatataattctatgcagaaaaaagatacgcaggcacaggaatcacaggagattacggcactcacaaagcgtgtggagaagctggaagaacagaatacggagatactttctgctctggaagaggctgctaagaatcaggaagcagcgatcgcacaggcacagagggatgcaaaagacaaagatgatgctgcaaaagaggatgcggaggaagctgacgctgcagatacagaagagtctgatgattcggaaaatgtatacagagatggtacgtataccggttccgcacagggatttggcggtgcgatcaccgtacaggtcacacttgcaaatgatgagatcacagatattcaggtgacaagtgcaccgggtgaggattccgcttatctttcgcagggagagggcgtgatcagttccatcatttctgcacagagtacggatgtggatacggtatcaggtgcgacattcagctctacaggtattatcaatgcagttgtagatgctcttggaaaggcggaaaactgatgaaaaagaggcagagaaaggtccgtttgatccgggctgccatacagcttgcattttttatcttttatccggcgcttttttcaacggcatttgcgggcgtgaaatctatttttcaggcaattgcagcacaccagcagattgcctggaactcatttcttgatgtgacaggattacttcttctggttacgattttgtttggcagacatttctgcggatatgcatgtgcattcggttcattgggagatgccatgtatgaactgactgtttttatcaaacagaaagtatttcataaaaagggaagacatggttatccggaaaaagcagtcagaattcttcagaaggtgaagtatatacttctggcatttcttctgctttccatcctgaccggatggtatgcatcccttcaggggatgagcccgtgggatgtcttttccatgctgacggcaagaaaacttccaaatgcttcttataagattggaattatcctgctggtgctgatcctgatcggaatgtgtacacaggaaagatttttctgtcagttcctttgtccaatgggagcagtttttgcaatgatgccgatccttccgtctgcactgtttaacagaaacagggagaaatgcccttcaaaatgcggactgtgcaggaagagatgccctgcacatctggagattgacggagatacaccgctttcaggggaatgtatctgctgtcatgcctgccaggtgacctgcccgcgcaagaatatacagatcggaccgatagatacagctcaggaagaacaatagaaatcaaaaagaatttacacttccaaaaaaattacaaagaacaaatagaaaatcatagaaataattttaggttcccactataatgagttcaaataaaagcgaagcaacaagtcaaaaacagggaggtttttactatgaagcgaaatatgaaacagtgggtaaccgattatatcaatgcaccagcaaagaaaggaatgccaattctctcttttccgggaatacagcttattggacataccgttgaagaacttgtgagaagtggagaactgcaggcacagtgtatgaaagcaattgcagaccgctttgatacaggtgtggcattcagtcttatggatctttctgtagaagctgaggcgtttggtgcaccggtacattacagtgaagatgaagtaccgacagttcacggaactctgatcaatgatgaagatgaagcagaagcacttaaagtaccaaaagtaggtgatggaagaaccggagaatgtgtagaaggtattcgcagggcatgcgaactgattacagacagaccggttcttgcaggaattatcggaccgtattctctggcaggacgactcctggatatgacagagattatgattctctgctatgaagaaccggaaatggtagagagcgttctggaaaaagcgacagaatttctgatcgaatatgcaaaggcattcaaagaagccggagcaaacggtgtctgcatggctgagccggcagccggacttctctcaccgaatctgatcgatgagttttctacaccatatgtacagaagattcgcgaagcagttgaggacgaaaattttgttgttatgtatcacaactgcggaaatatcacaccgctgatgcagaatatcagtgacattgatgctgttgcatacagtgtgggaaacgcaattgacatcgaagaagcattaaaagtgattcctgcagacaaaatgattattggaaacattgaccctgcaggaaccatccgtaacggaaatccggagacagtttacaaagagacaacagatctgctggaacgctgcggcaaatatccaaactttgtaatcgcatcaggctgtgatattcctccagtatctccgatggagaacattgaggcattctttgatgcagtaagagatttctataataaataagggggtacattctgtacataacaaaaacagtatcgctgagtttcagcggtactgttttggcgttaaaccggtatattttttgaatactttagaaaaataactctgatccataaaaccgactgccatggcaacatcaatgatcgagtattctggattgataagaagacgtttgctttcttcaatccgtaccatattcagatattctttaaaggaagaaccagtagactgcttaaacagtgtagagaaataagcagggttcaggtgtacatggctggcaacatcctcaagcgtcagattacctgcaaatgtttgagagatatagcggattgcttctttaataatctcgttattttttgttggaatataattaaacatacattgtgtaaagacttcgacggattcctgaagctgataacagaggtcatccagagtgttgattgactgcagagaacgcagaaactgattgtttatcttcagaacgctgtcgctggtggcaccaccttcgatcgctgcacgggaaagaagtgagcaaagttccagagaacgtgtcttgacgatttccaggttgcttccttctgcaaagaatacatatccgagcagatcattcagaagttctttggaactttccgtatctccggtttttaatttggtgatcagtgccttttctttgtcataaggatatcctttattgttgatattggcagaagctttgtaggtctgaatagattcattgatctcggattgctgcagaaatttattatgattcagcacgaactggttgcggccgtctgttacaaggccggaacacatataatacagaaggcggctgatgtaagtgacacgtgccggctcgaacattggcagagtatcagcctcttcatacatttcaagaaggcttgttgtaggtatggagtattttttgccgagatttgaaagtgtcagagaatccggctggtccatcatgaaaggcccggcaaggatagaacccagaagtatattgttattggacaaaggaaaaacaatatggttcagattggagtgacaggaaaaaatatacgcctcaccaaggctcattgccagtttactggcatttgcatgaagtttcatacaggattcatttacaggaagaaattttttgaaaatacggcagtaggcatgtgtctgaccaaagctgtccaaaatctctcccttctcattcaagatctgtattggaagattaatacattggtaaaaagtttcaagcatattgtgaagatgatgacggtcaataatattgtatagtaatggttgcacaaaaatatccccctaaatcgaaaaaaaatactaaaagttcataactataatgtattatacctgcaaaaactaaaaaaatatataggttttctaaaaaaagaaataaaatatttttggtaaaaattatataatatatttgtacaaaacaaagcggagatataagaagatagcggaatcttattatattggattaatggaggtagaaaaatggcagcagaaatcgtaaatgaaatcagtgaatttcttcagaaaggaagagccaagaacgttaagaaacttgtgcagcaggctcttgatgagggtgttgatgcaaaagaaatccttgaagagggacttctttccggaatgatgacaatcggtggaaaattcaaacgtaatgaagtgtttgtaccagaagtacttgttgcggcacgtgcgatgaatgcaggtgttacaattcttgaaccaaagcttatcgaaatcggaaatgaaccgatcggtaaagcagttattggaactgtaaagggtgatcttcatgatattggaaagaaccttgttgttatgatgatgaaaggtgcaggattcgagattgttgaccttggaacagatgtaccggcagaagcgtttgttgataaagcagaagaaatcggagcagatgtaattggtatgtctgcactgcttacaacgacaatgccaaatatgaaggatattcttgatgttctggaagaaagaggactgagagataaatatattgtcatggcaggtggagcaccagttaatcaggcatttgcagatcagatcggagcagactattatactgaagatgctgcttcagcagcagaagttgcaaaagaagctgtattaaaaagaaaagcaagctgatttgcttggctttaaaaagaggatgttacggaaatggcagatgcccttttggtagcatctttttttataaggggtgtggcagatggatgattggatattagagggacttcagatacagattgataaagaagaagtctttaagatgatagactgttatgaggacagtcctgtttatgaagaagttgcagaggagtacgatgaaattctggaggatatgagggcactgctcaaaccgatcggaatcataggtcttggagaaattaccgaaaatattgcaacagaaaaatacccggccggaaccagaactatttttgctgttctcagtgtgggtaatgagatcaaagaagaaagcacaaaatatttccatgaaggagattatgtcagaggaatgctgattgatgcgattgcagatacagctcttttttcactggatgatgccatgatggacactttacagaagttttgcaggaaacataaagttgggatccgtaagcgtctggaggcaccgcatgatatatccatggaagcgcagaaagtggcatgggagagattgcagctgaaagaacgttttcatattgacatcagtgagggattcatgtatgatccggtcaaaacttcgtgccagatatttgttttgtcagatgacaaagaggagttcagggcaaagcacgactgcagatcctgcaataattttacctgcaaacaccgcagagtgcagccggtgcagattaccgtacataaaggaatggaggttggaagcttcgagttaccgccaatgatatccctgatggaaggacttcgaaaagaaggttatcagttcgcagctgcatgtgggggaaaaggtctctgtggaaaatgccgtgtgagggtaatgaatgagggcacatatattacggcagaggacaaatctgtatttaccgaggaagaacttaatgatggatggcgactggcatgcagagtgtatccgtcagatgacctggaaatagaattttcactggatgatgaaacagaatttgaagtactgacgggcactctatcggaagaggattacggtgaagaaggcaatgcaggaaagataaccgcagtcagggaaaatggatacgaagtagcagttgatatcggaacgacgacgatagcaatggaactcatcggaaaagacagccataaagtattgggaaaagctgcttttattaacagtcagagagcatatggtgcagatgttatctcacgtatccaggcatcaacagaaggcaggaaggaagaacttcagaaatgtatccgtgatgaccttgaaaaaggcctgaaacaacttgtaaaagaaaatgaacttgccctgacagaaatcaaaaatattgtgatcagtggaaatacgacaatgatacatcttctgatgggctatgactgttccagccttggtgtctatccatttacaccggtaaatatcggtctgatccgtggaaatgcagaggaaatcctcggaatgaaagagatggatgcagaggttcagattctgccgggaatttctgcttatgtaggcggagatatcgtatcaggtctgtttgcatgtgattttgacagaaaagaagaagtttgtatgctgatcgatcttggaacgaatggagaaatggcaattggcaataaagacaggattctggtgacatctactgccgcaggaccagcttttgaaggagggaatattacctggggaacaggaagtattccgggggcaatctgcactgtgcatatcgaagagaataaggctgaagttggaacgataaaaaatgcccctccggtgggtatctgtggcactggtgtagtggagactgctgctgaacttctgaaagaggaactgattgatgagaccggacggcttgaagatgaatattttgatgaaggatatccgctggctgaaacaaaagataacaggatgattctttttacacagaaggatatgcgtgagatccagcttgccaaggcggcgatccgggcgggagcagagactctggcgtgtcgctatggaatcaataaaacagaaatttccaaagtgtatgttgcaggaggatttggctataagcttgatacagataaggcaattgcaatcggtatgtttccggaagaatttgaaggacacattgaagcagttggaaacagctcgcttggtggagccgggaaatatctgtgtgaagcagatgtggaagaaagagtgtccagcctggtgaaagtgtcggaagaaattgcactgtcaacggataaggtatttaatgatttctatatggacgccatgttctttgaataaaaaatataaacaaatgaaaaaaaggactaaagcgatgaaaatattgaattcatatttttatcgcttttttttataatctttaatagataagaaaagacgtacagggacggtggtgattcctgtcagatatgccggaaagaaatggaggaggaatttatggtacgaagatttggacagataataaaagcaaaaccggatggactggctgattataagaaatggcatgcaaatccaatgcagggtgtcaatgaaatgattaaagaatgtggactcaaaaactactctattttcagtagaggcgattacctgtttgcttatttcgaatatgaaggcgaagattttgacgcagatatggcaaagatggcagcagatccggctactcaaagatggtgggatgtagtaaaaccactgatgcagccattagaagattgtgcagaaggtgaattctggtcagatatggaagaaatttatcatctggactgaaaacaggagagagataaaaattaaaaaaacagcaatgaaatataaaaaatagaaaaagaggatgatgatatgaacagcagagagagattttatgcaactgtagagagaaaacctgtcgacagaccggcatgctggctgggagatccaacaccggaggcagtgcctgcattatgtgaatactatcacgtagacaatattaaagaattgaagaaagtatgcggagatgatttctatgcagtagaaattccttacaaatcacctacctgttctgcgatttttgcggcgtttgactggtatatgaacggaagtgatattgatacagagcacagaacactgacggcagaaggatgttttgcacagtgcgaagatattgaagatatcgaagcagttaattttgaatggccggatccagcactttatattgatccagaagaatgccgccgtctggtagacgaagctccggaagacaaggtcgtcatgggaatgttgtgggcatgccatttccaggatacatgtgcagcatttggaatggaaaactgtctgatgaatatgatttctgatccggaaatggttcattatgtagatgaccgtattgttgatttttatgtaaaagcattaaaaattttcctggaagctaccaaaggcaaagttcaggcaattctgatcggtaatgatatgggaagtcagagaggtctgatgatcagtccgaagctggtaaaggaatttgtgattccgggagctaaaaaactggttgaagtagcacacagctatggggttaaggttgtttatcattcctgtggttctattgtggaagcaattccgtttctgatcgaagccggagtggatatcattcatccgattcaggcactggcagcaggcatggatccgcagaatctgaaagataaatttgaaggacaggtttccttctgcggtggagttgatacgcaggagcttcttccaaacggaacaccggagcaggttgctgcgaaagtaaaagaacttcgtacaatctttccgacaggtcttatcatttctccaagccatgaaggtcttcaggatgatgtgccacctcagaatatcaaagccatgtttgatgaggtaaataaaatttattaataaaagggatgtttaacaaaaaataatatcggaaatttcagggatactgtacagaaaccgtcaggcagaaacgggctgtgcagcatcccttttggtctttgtcatgaatgagaagttacggcgaacagtaacggaaatctgaaaacaggtaaaagcagttgcttaaataaagagttttccttaaaatagaatatgaacatgcatgggggaaaagggggaactgtatatgtatacacttttaattgctgatgatgaaccattgattcgtaatggtgtaaaaaagattatagattgggaatcactggggttttcacagatttttctggcagaagacggacaggaagcactggatattataaaatcaaagcatgtggatcttgtgctgacagatattgtgatgccgtttatggatgggctggaactgagtgagattctgtcgagagaatttcctgatattcatgtggtaatactgacggggcatgaagactttgagtatgctcagaaatctgtaagtctaggagtgaagaattacattctgaaacctatcggggcagagagtctttataaaaagatggttcagatatgcgaaaaacttcacattgagaataagcagaggcaatatgtattctctatgaaaagccagcttcgacagagtatgccggtgctgcgggaacagacactgaataaaatcgtctgttcagaaaacagagatatcaatctatatttggaacgtgcaaaaaatatgaatatcaatctggagaggggaacgtatgaagtaggagttctggattttgatctggataatatttcactggcagattatgatctttatctgtttgcggcaaaaaacattgcacgtgaatgtctgggagaagcacactatgtatttgaagatggaagagaccggatggtgatcctttttcagtgtgactctgtgggtgaggaaatgcatgaagtattttatgatactttgtgcgtgatccagaaagcgatttttaatacgattcagattaagacaacatgtgcggtgggaaatccggcatcttctgcaaaagaactgaacagtgcctacagaagtgcagagaaagctctggaatgtaagtattcactgggaagtgatgctgtttatgatattgcagaccttaactatcttgagaaatcgttttattatccgtatgaagaaatgcataatcttatcaaaggaatcaagatcggaaaccgggaacagatcagagatgcgataaacagtgcatttcataggggcggttcgctgtcaggaaaaaatgttaagatgatttatattgaggtggtaacttctcttttgagggaactttcggctctgaaggaagtttctgaaaaaatatggaagtggggatttgaactgtatcaggattttgaatggttcagttcagtgaaagatctggaagaagaattatatcgctttgcctgtgaaatctgtgagcagatgaattctgtccagaccaacagtggaatgcaggttattgatagggtgaaagaatttgttatgaataactacagggatcccgaactgtcattaagttctgcagcagagtatgcttccgtaagtacaggatatttaagtggactttttaagaaagaatctggtacaaattttgtaaaatatctgacggatgtgcgtatggaaaaaagtatgcagcttcttcgcacaacggacatgaaaacgtatgagatcgcgtatgaaacaggattttcaaatccgcattatttcagtatttcatttaagaaatataccggaatgtcaccttcggaattcagggcaaaggagtaagatatgaaaaaaataaaatctgctggattaaaaaacagagccctgaagcggatgacgacacttattatatttgccatgatcgtgatggtaatgttgttttatgggattgtatattccagaattatccgtaatcaggggaaaaaccaggagaaaagtcttgcaaatctggatgcatatctgaacagttactttgaagaagtagattccattgcaaaaaacgtaaattataattattatcttcaaaattatctggaaacagtgatagaccgggaggacaattatacagatccatctgtcagaaaaaatatgcgggcatatgaaatgagctctcaggcgtttagtgacactctgctttccagaccggatatttcttctgtcatgatttttggaaggaagaaagtactgctgaataagtcactttacagtttaaggaacgttgtgatggattattcggatttggagtggtatcagaaagcaataaaaaccccatatgatatggtgatcacaggcccgaaccatcacagattttttgatacagatgatgaggcaatatcattgagccgggagatacaggactatgaaaacggaactttccttggagtcatactggttaatcttaatatgaataaaattacagaaatatgtgattcatttaagggaaatacaactggtgcactggcaattgtcaatgaagccggagaaaaaatttatctgaacagtagcagtacaagtatagatatacagaacctggatatgaaggagcttacagaaacagcagaacaatattcagaaagtacatttcgtacgagacttgatggaacggagtactttgttacaaagaaaaaaatgaaaagtacaggctggaatcttgtacatattgttccgcaatcctggatgcttgcagatatgtggaaaatcagtatgctgatcgttgcggcagttgccggaaccttgctggtcactttgttcagcctggatcgtattctgacaaatgtcatacggccgttgaaaaaactggagagacatatggaaagagtgagtctggaaaacctgagtgaaaaggtagatattacaacagatgatgagatcggacatcttgcaggcaattttaacagtatgctggaacgaatggaaaatctgaaggaacaggtagtagaggagcaggaagacaagcgaaaatatgaacttcaggcactgcaggcacagattaatccacactttctgtataatactctggattcgatcatctggatggcagagacccaggattccaatattgttgcgatgacagaagcacttgccaaattgttccggatttccctgaataaaggaaatgaagaaattcttttgaaaaaagagatggaacatgtcaaaaattatctgatcattcaaagtatgcgttatgcggacaagttcacatttgaaatctgtgtggaaccagaggtggacaagtgcagaattatcaagctgattcttcagccgattgtggaaaactgtatttatcatggtataaagaaaaaacgtggaagtggacatattataatccgggcatttcattcagaatcgaatcttattcttcaggtgaaggatgatggctgcggtatgagcagggagacctgtgaaaaaatgctttcatatgaaatagaacaggagaatatcagtggttcaggaattggcgtaaagaatgtaaacgaaagaatccaactcaggtttggcaaggagtatggattgcactatgactcagaagagggaaagggaacaactgttacttatactcttccgtactgtacagaggaaatggaaaatgcagaaaactaaaaaaataaattatattagaaaatacagaaaaattctgtctctgtccataattgttctgttggtgatttttacaacagctgttccgggagttcgtggaaatacgaacgaaccggaagatacagaaggcagtgcaaaggtaatcggggtttctcttgcatcagaacaggcgagctatcagcaggcgctgggaaatcttctggaagcagaagcagagcatgatccgaattaccagatgacagtgcaatatgcgggatggagtatatcggaacaggagaaacagctgaagacgtttataaaagaaggcgtagatgcgatcatactctgtccggtaaatgcaaaatcgtttcttaatattatcaaagatgccagaaaagcaggaattcctgttattaatctgaatatgaaagtggatacagtttctacagaatatattacaacatatgtcggaggaagtatgtccgaagaagcggatatggcaggccagatggctgtggagtgcctgggtgaaaaaggaaagattggtattatagagggattgcagggatctgatccacagatctaccgtacacagacatttctgaaatatgttgattcctatccggatattgagattgttggaatcatggagggaaactggtccaggcaaaaagcagcacttgctgtactggatctgataaaaaaagacaaagatattgatctgatctattgtcatgacagtaatatggcgatgggggcatatgaaatgctgaagaaaaaagggctggaaaaacaaattcatgtgattggaattggcagtgagcagatttatatagatgccgtacgggacggaaagttatatggaattgtcacacagtcaccggaatttgaggcaagttttgcatggagctgtgcgaagagagcggcagagggatttactttacgtttctggtataaaacaccggccagtatcatgacaaaagaaaatgtggatcagaagtcataagatataaaatttattacctgaaaaaagaatacaaatgtgaaaaataagactaaaccgatgaaaaaattgaatttatattttcatcggttttttttacaataggatcatcaaataaagaacagattcttttaaaagcggaggtaaagaaacatgaaaagaagattagtaagcgtattaatgtgtacagcaatggtgcttggcatgacagcaccggttatggcagccgacaaagataatgcagatattacaatcggttctgtaattatgaataattccggcgagtggtttgcggaggttatgaagggccaggaggatgcggcaaaagatcttggagtagagttttctatcgtatcttctgacaatgaaatttccaaagaatctgataatgtagctacattccttgcacagcaggtagatgcactggttatttctcctctggcaacagatgcttctgtagcagcagttgaaagtgcaagtgtagatgcgggaattccggtagtaacatggaatacaactgttgatactgatgtaacaagccatatcggtgttgtcccggcagaacttggtggaaatacaggaaaatatgcggttgactacatcaaagaaaactttaaagacggatgcaaagttgcaattatcggagacagcaactatgaaatcggaattgagagatgtaatggtttcaaagatgcaattaaggaactgacggatgatggaactgtcgagatcgtaaatgagcaggatgcagagctccaggaagagggaattgacatcaccgagcagattcttacagcaaacccggatgttcagatgatctggtgctggaaccagacttctcttctcggatgtgcagcagccctggaaaatgcacagagatctgatatagtacttatgggaacggacatgtctgtagagcttgcaaaagatatgcagggcgactccattaaacttcaggcgatcacaacacagatgccatatgaaatgggatatcaggcagtagaaaatgctgttaaagcagttaaaggtgaggatgttgaaaaagaagtcatgattcctacttacacatatacaaaagaaaatcaggatgaaattcagacatatattgacgaacatcaggatctggttggctgataacagagagtgaaaagtgttagggggtgttccgttggaacacccttacttatggaatataaggagggaatacacatgccggatgtagtattgagagcagaacatgtgacaaaaaggttcggcggaattactgccctggagaacgcggaactggaattatataaaggggaagtacacgctcttgtaggagcaaatggagcaggtaaaagtacgctgattaaaatcattacaggagcttatccaaaagatgagggagatatttatctggaaggacagaagatagagataaaatctacttttgatgccagagcccaaggaatcagtgcggtatatcaggaattttcactgatcaacacggtttcggtggcagaaaatatttttatgggaaaactgctttataacaacctgggtccaattccgagggctgactggaaaagaatgaatgaagaaacacagaaacttctggacagtctgggtgtaacaaatattaaaccagagagtattgtcggaaaactgagcgtagcccagaaacagatggtggagattgccaaggcactgtcaaatgatctgaaagtgctgattatggatgaacctactgcttctctttcggacaatgaaattgaaaatatgttcaagatcataaaagatctcagagccaaaggaatcagtatcatatatgtttctcacagattagaggaacttccgattatctgtgacagaatttccgtttacagagacggtcattatatcaaaactatggatatcgaggatgcaccgaaacaggtaatcatcgaaaatatggttggaaaacatatgacacagactgagcaggtgaaatgttatacagatgaagtacttctggaagcgagaaatttttcttcaggaaagaaattccagaatatcaatcttacactgcacaaaggtgaaatccttggcattgccggacttgccggtgcaggaaggacagagtttgtccgtgccctgtttggagcagatccgaaagactccggacaggtatttatcgaaggtaaagaggtgcagattcactctccaaaagatgcaaagaaagctggactcggatttatcactgaggatcgtaaagaagaaggtctgatactgaacatggatcttcatacaaatgtaggcatggcgatcctggatcaactcaaaaaaggatttggacttgacctgaaacaagagagtgtacttatggatgaatacataaaatctctgagtatcaagtgtagagacagcaaccagaaagccaaggcattgagcggtggaaatcagcagaaagtggttattgcaaaatggcttgcaacgaaaccgaaagttctgattatggatgagccgacaagaggtattgacattggttccaagaaccagatttatgcattgatcaatgatctggcaaaacagggaatcggaattattatgatttcctcagagttgccggaagttcttcaggtggcaaataatatcgttgtatttgcagccggtaagataaccggaagacttgaaaataaagatttgacacaggatattctgctggactacgctaccagccagaaagctgtatgatggaggtagaaaaagatggagaaaaaatcttttgatataaaaaaatttttgatgaaatatgtaatgtatctgttcctgattctgatgtgtattgtactcacagttgcaagtgataaattcctgactgtaaccaaccttatgacaattatcaaacagatttctattcagtccattgtagcaatcggcatgacaatgatcatcatcagtggaaatattgacttgagtgttggttctcttgtagcactctgttcagtatctggtgcgatgatcatgaacaaaggacttccgatgattgctgcagttatcgcttctgtcattattggtgcacttgtcggatttataacaggtggtgttactgcaaaactgaaactgcattcattccttgtaaccctgtcacttatgacagcacttcgtggtttggcacagactatgacaaacggtcgtccggtagccggacttccaagcgcatttggtaagattgcatctgcaagtattggacctgtgccgcttcttgtaatctacatgatcgtactgtatgcaatctttatgtatgtgatgaaatatacagcatttggacgttctatttatgcagttggaagtaaccaggagtcagcaaggctttccggtatcaatatcgaaatggtaaaaacaatggtatttgttatcagtggtgctctttgcggaattgccggcgtgcttcttacggcaaaggttcgttccggtgacccgacctgtgcaaatgcctgggaaatggacacaatcgctggtgcgatcatcggtggtaccgatatgaatggtggagaaggtaaacttggtggaaccattattggtcttctgttcgtaggtatccttgcaaatggtatggtactcctcggagtaagtgcttatatgcagagcgttattaaaggtcttgtaatctttatggcagttatcataaacagtatccagaagagaagccagggctgatagaaaaatatttcgaaagttaataatatataacttgctgtgaaaatcaaattgtggtaagatatagccgaaagataaatacgcattcgttgtctgatgcagcgagtgcgtatttcggttataaggtgttaagggagaaattaaacagtgataaaatataattttaacaaaaaagcagcaagtgtattgacagctgtcacaatcagctgcacagtctggtcggcagctccggtactggcggatactgaggtacagaactatacaaataccgattttgcaatggatacagttgtgtctgaaacattgtatacaacaggagatgacctgaatactgcaattggtcagaagatacgggatattgagacagagtatctttcctggacggatgaggattctcagatcgcgaaactgaatgcagcatcgggagaaacaacggaagtttcagatgagcttgccggctatttggaaaaaatatttcagcttgcgaaggattcgaatggagcttttgatccaacgattggaaagatcattcgtctctgggatattacaggagaaaatcctcatgtcccggagcagtcagagctggatgaacttctgaaagatgtgggataccagaaagtatctctggatggcgataaggtaacgctggaaaaaggagctactctggatctgggagcaaccggaaaaggaattggctgtgatgtagtttctgattttctgaagacacaggaagatgtgtcaggaatgatcctgaaccttggcggtagcagtgttatggcttacggcgagaaaccggatggttctgactggaaagttgctgtgactgatccgcgtgatgtcgaaggcgattaccttggtgcgatcacactggagggcggagaatttctttcgacttccggtgactatgagaaatacttcatggaagatggaaagagatatcatcacattctggatccgaagacaggttatcctgtatggaatggcctcgattccgtcacagtgatctgtgacagcggccttcttgcagatggtctttctaccgcgtgctttgttctgggaagggaagatgcgctgaagcttctggaaaaatacaatgcagaagctgcttttgttgaggaagacaagaatgtgtatctgactgatggattaaaagatcgatttgaattgatgaagaatacctatacagtgaaggatgctgaatagaaataaagaacacagaaaaccctgctgtggtttcgcaaaagcagatctgcgagactgaagcagggttttgttattgccagaaagaatatttcctaaaaatggatacgtttcaaaacttcattagtcagtgttccaatcagtaatccggtaatgacaccggagatcagcagtgccggtgcatagtagatcagaccggacgtcatggtgatcagacaggcaatcaaaagctgaccaatattatgggagacacctccggcaacactgataccgaggatgctgaagtcggatttttttttcataaccgtcatgacggtgaggcttaaagctgcaccggccagactgtacagaatactgaaaagatttccgaacatgaatccgatgataaagatacggatgacagaaacaagggcggcttctttccaggtatatttttcaaggataaacaggactgcaagattggccagcccgagtttcattcccggaattccggcaaaaaagggaatcagtgattccacatagccaaagatgattgctactgcggcaaaaagcccgagattggcaagttttttctgattcatggcaggttcctttcagggagaattctcccggaatgatgataaagtttcagacagcagtatcgaattcaggggaatcttcattgagggattctcctttttcgccttcaatcacaactttattcggcagacagacaatcgttccaccggtactgtcaactgctttctgtttcatacagaggtggtccgggcagtcggcttcggtcattttgacctcgccgttttttatttcgcatacattggttccgtttattttgatcacctgatctttcccaagggaataggtgccgtattcctcgccgtttacggtaattcgaatacttccgtaattcccgcagcgggtgagatacatgccaccccagaggagcagggcaaacaccacgatgccaataataaaagtcagttcttttttcttcaatttcaatacctcagtcaaaaaagtatgttcataagatgcgtagaaggttgagtttatggtttcttttgaacttacagatacgcagattatcatagcatatcgaagattgattgacaagcacaagttagaaataacaaacaaatgcacggggattcgtcatggacatactttatttaagaaatattcattgttttccccggtggaaagtggtaaaatagtagggatttcttaaataggacaaatacgataattttgtatataagcgatcaataaatacagaaacaggagcaggctatgaatttattccaaaaagtattcgggacaagaagtgagcatgaagtaaaacgtatcatgccgcttgtggagaaaacagaatcactccgcccggaaatgcagaaattaacagatgaacagttaagagacaagaccagagaattcaagaagcgtctgagtgaaggtgagacactggatgaccttcttccggaggcttttgcggttgtacgtgaaggtgccaaacgagttcttggtatggaacattaccgtgtacagatcatcggtggtatcattcttcatcagggccgtatcgcagagatgaagaccggtgaaggtaaaacccttgtttctacacttccggcatatctgaatgcattggagggtaaaggcgttcatatcgtaacagtcaacgactacctggcaaaacgagatgctgagtggatgggtaaggttcatgagttccttggactgacagtaggtgttgtcctgaatgatatgaaaccagaagagcgccgtgcagcatacggatgcgatatcacatatgtaacaaacaacgaactgggatttgattatcttcgtgacaatatggtcatctataaagaacagctggtacagagagatctgcactactgtatcatcgatgagatcgactccgtcctgattgacgaggcacgtacacctcttatcatttccggacagagcggtaagtccaccaagctttatgaagtatgcgatatccttgcacagcagttggaacgtggtgaagccagccatgagatgacaaagatggcagccatcatgggtgaagaggttgttgagaccggtgacttcgtagtaaatgaaaaagataagattgtcaatcttactgaacagggtgtgaagaaggttgagaaattcttcaatattgaaaacctggcagatccggagaacctagaaatccagcataacatcacactggcacttcgtgcacataatctgatgcacaaagaccaggattatgttgtaaaagatgacgagattctgatcgtcgatgaatttaccggacgtatcatgccgggacgtcgttattctgacggacttcatcaggcaatcgaagcaaaagaacatgttaaggtcaaaagagagagtaaaacgcttgcgacgatcacattccagaacttctttaataaatatgacaagaagggcggtatgaccggtacagcacttacagaagaaaaagaattccgtgatatctacggaatggacgttgtagagatccctaccaacagaccagtacagcgtatagacctcgaagatgcggtatatatgacaaaaaaagaaaaattcaatgcagttgttgaggctgttaaagaagctcatgcgaaacagcagccggttctggttggtacgattaccattgaaacatccgaacttctcagcaagatgctccgtcgtgaaggtattgcgcataacgtactgaatgcgaagttccatgaactggaggctgagatcgttgcacaggccggacaggcaggagctgttacaattgctaccaacatggcaggtcgtggtacggatatcaagcttgacgatgtggcaagagaagccggtggtctgaagatcattggtacagaacgtcatgagtccagacgtattgataaccagctgcgtggacgttccggacgtcagggagatccgggtgaatcccgtttctatatctctctggaagatgatctgatgcgtctgtttggttctgagagactgatgaagatctttacttcacttggtgttgctgagaacgagcagatcgaacataaaatgctttccaatgcaattcagaaagcacaggagaaaatcgagttcaataacttcggtatccgtaaaaatcttctggattatgaccaggttaacaatgaacagcgtgagattatttacaaagagcgtcgccaggttctggatggtgagaacatgcgagatacgatctacaagatgatcacagatattgtagacagtacagtagacatgtgtttctctgatgatgtagatgcggttgactgggatctgaatgagtttaatacaacactccttccgattattccgatcgagccgcttactacagagaaagtaaaaggcaagagaaaagatgagatcaaacatctgatcaaagaggaagccgtgaagctttacgaaacgaaggaatctgagttccctgaagcagagcagctgcgtgaacttgaacgagtagttcttctgaaatccatcgacagcaagtggatggatcatatcgatgatatggagatccttcgtcagggtattggacttgtaggatacggacagagagacccagtagtagaatacaagatgagtgcttttgatatgttcaacaatatgatcagttctattcaggaagatacggtacgtatgctgtatcatgtccatgttgaacagaagattgaacgtgagcaggtggcgaaagttaccggaacaaacaaagatgacacatctgttaagaaaccggttcagagaaaagaggacaaggtttatccgaacgatccgtgtccgtgcggaagcggcaagaagtacaaacagtgctgtggacgtaaattgatgaaagcataatatattaatatataacagagcaccgattcatatattgattcacaggtaaccggataacgatctggcgaactaactgctaactatgactagacattctctcaggaagaccttcgagaatgagtcatcgtaagcagtggattttgccagaatctaaaatcatccggaaataacctgttcattcaatatatgaagcggtgctcttgtttatatacaaaaactccctacatgatccagttatcatacggggagttgatttcacgctattcatctagaagaatttcgcgatttcttcgattggtttacggtgtgggcggattggttcttcggctgctttgccgactgcgataacggatacaatagtctctgtttccgggatgtgcagaatctcacggagtctgtctgcttcacggagtcccatgatcagagtggacagaccgagatctgtggctttcagaatgagattttcgttctgcagaccaagatcgtagcatccccatccgttgccgagttcgttatcagcactgccgtctttctgaaaaccggcacggtcatgaacgaaggttgtgatgatcagtgcggcatgttctgatttaccggcatttccggcgtccggcaggcattccacgcggattttatctaccatctcttctgacaggacacagtaataacggccggtctgggagtttttccaggatggagcttcctgtgcggcacgaagcagttcttccatctgttctctggtgacaccggcactgtatttacgaacggttcttcttgtttctaatactttctgaaattccatgagattcaggcctccttaatatgtaagaattatatgaaataaaaatggcatacagaagaaaatctgtatgccataattatgccattttgtgatgaaaattgcaattctgcagtaatatcttacagagtgctttgttgtgtatgaatgtggatcggaaaaggtttatcttataaaaagatatgctgtatatccgatataagccagtgcacaagctgcaccttccattctgctcacagattttttagtaaatgcaaaaacaaacagcagaattccactgatgaggaggattccacagtcgataacagattctgagagaatatgaagtggtgaaattgttgctgacattcccaggataaaaagaatattaaatatgtttgaaccaattgcatttccaagtgcaagtccgctgtcaccctttcgtgttgcaacgatggacgttacaagctccggaagagatgtaccgattgcaacaatggtgagaccaatgaaattttggctcacaccgaaagatactgcaatctgacttgcattatttaccacgaggttaccgccgaaaattacagcggcaagaccgccgatgataaaaagaagagctttataaagtgttatactttgttccgcggggcattcagttctcttttttaatgcggtacgaatcatattcagaatataaaagatcattccggccaaaagaagaattccctcaattctgctgagctttccgttggcaatcattatgcagaggataactgtgatcagaatatttacaggcatatcccgctttaaaatatctttatttgttttaaacccggaaataaatgcgcagatacctacaacaataagtccattaaaaatattggaaccgataatattgctgacagcaatatcattgttgccggcaagtgcagcgttgatgctgacagaagcttccggagcactggttcccatggcaacgatcgtaagacctatgatgacgctgggaatcttgagaaacctggcaagtgaagaacttccctccacaaaaaaatcagcacctttaattaataatacaaagccgataatcagtaacagatattccatataagctcctttcctgtgataaaagcatggaataaaaaaagagacctttatcacatcaaaaaaattgattgataaaagtctcgttgattacaacaataaccggccgcagggcgtgatgacgatcattgtttcaccctgtgtgcaggatgataactactccctcttattgatattataataaacaaatggagagaatatgtcaaatagaatttgattccagattaattagaaacaaccactacctgtgaacatttgacatattcgaggttattcacaggaagggactttgccaaattgcttcttataagctcttacaaatgtggtgtagtcctggaaaccacttttttccgcggctttcatgacaggagttccttgagagagcaaagaacgtgccagaagaagtcgtttgttagtgacatagctgtgaatggtgtagccagtctcagccttgaacttacgcatcatgtggtatttgctgaaaaagaaatgatctgcgagctggtcgattgacaggtcgtctgacagatttcgattgatatatttcagtagctgttccacctgagaatcggaggaatatgattttttgtcaggtgtactgctagtacgcagaaaaatacgattgatatataccatgaattgagtgaacagagcatttctgagagcttcttctccaaactgttcatttcgcaaagtctgttcaatttccggaagcaggtctttcagatgctcctgaagagtggaatcggctcttacgagattgaagctgcgatcattggcacagtgaaaacaggtattcagttcctggcaggatagatcgtctcgaatccagaaaatatagcgttcataagggacagtcggatcaatttccggtttgtggattgccccctgactgacaagcaggatatctcgcggtttgagatgatacgccttaccttctatgtgataagtcacttttcctgaaataaagacgatgatcttatggaaatcatggtagtgataagaaaattcttttttggtacggtcgttgatatgaaacagacgaaaatcttctttcagatagcctgttttctcgtggttgtactgcgaataatccataatatcctcccgaaatctgaaacaatgcttctatcgtttagtttatctcatgatagcattttttgcaatatagcaggcattttattctatatacatggcaaaaagaaaactatatactgtaacaaaaggtgcgcaaaagatgtgcagaagtaaatctattcaatttggaaagagaggatatggttatggataactgtattacaatgataaaatatcagggacttggaaatgattatctggtgctggatccaaacaaaaaccgtgtacaacttcagggcaagaaaattgcactgctgtgtcagcgaggctttggacttggcgcagacggtgttctctacggaccgattgagattgatgggaagatgggcgttcgtatttttaactcagatggaagtgaagctgccatcagtggaaacggtgtccgtatttttgcaaaatacctgatggatcatgaatatgtaaaagagcagaaattcagtattcagacactttccggaccgatagaggtggaatgcctgaacaatcgtgctactgaatttcgtgtaaaaatgggcaaagcctcttttatctccagggaaattccggtaactggagaagttcgtgaagtaatcaatgagtcctttacttttcataataaagagtacaaagctacctgtctgaccgttggaaacccacattgtattatttttatgaatcaggtgacaccggaactggcaaaagagctcggaccatatgtggaaaatgctgatgaatttccggaaaaaatgaatcttcagatctgccgcaagatcgatacaggcaacctggacattgaaatctgggagagaggttcgggatatacaaaagcctccggaacaggaagctgtgcggcagcggtagccgcatacagacttggacttgtcgaaagcagagtcaatgtaaatcagccgggcggtatgattcagattgatattaaagatgatgatacgatctatatgactggtacagtcggatatgtggcggatatgagtgtggctgagagcttcttttcataaaaaatataaaacataattacgagatatattctaagggaacagtgtaggacgactgttccctttctttctgacttatggtaagataaattaatattatcaagacttacgagggaggaactttccgatgaatataacaatgcttggaacgggaaatgcaatggttacggagtgctataacacatgttttgttctggaggatggggataaacatcttcttgtcgatggtggtggtggaaatacactgcttcgtcagctgaaacaggcaggttttgattggaaagatatgcgcgagatctttgtgacacataaacatgtagaccatatcatgggggttgtctggatgatccgcatgatctgtcagaatatgaaacagggacaatatgatggagaagcaactatctatggacacgaggaagtcatccgaattctcaaagaaatggcagagatgctttatccggcaaaacagacctgctttattggagaccgtctgcatctggttgtggtaaatgacggagaagaaagagaattgatgggacataagacaacatttttcgacattcagtccaccaaggcaaaacagtatggtttctgcatggatatgggaaatggagaaaagcttacctgttgtggtgatgagccatataatgaatgcgagaaaaaatatgccgagaacagcaaatggctgcttcatgaagctttctgcctttatgatcagacggatatttttcacccatatgagaaacatcattcaacggcaaaagatgccagtgaactggcagaacagctgggagtgcagaatctgatcctttaccatacagaggataaaaacatcgcccgccgtaaagaattatatacagaagagggaaagaaatatttcagcggtaatctgtatgtgccggaagatctggaaaagattgaattataggcaaaattatggtattgtataacagtatatgattatttatatttattatatagaaagaaggtgaagctgtggttgaattagatcagttcaagagtattcttgcaacatacacagaaccattagtggaagtgagggattcactttgacctcgctaataaagagcagagggttgaagaattagagcgtgaaatggaagcaccggacttctgggacaatgcagaagtttcccagcagaagatgaaagaactcaagagcatgaaggacgatatggaaatctatcacagtctggaaacccagatggaagatatggaaaccatgatcgagatgggctatgaggaaaatgatccggaaatcattccggagattcaggaaatgctggatgaattccagaagaattttgacagtattcgtgtcaaaactttattatcaggagaatatgacagtgaaaatgcgatcattaagctgaatgccggagccggtggaacagaagcctgcgactggtgtggaatgctttatcgtatgtacagccgctgggtagaccgtaagggatttacaatggaagttctggattatctggatggagatgaagcaggtgtcaagtctgttacattccaggtaaatggtgaaaatgcttatggttatctgaaatccgaaaagggtgtacatcgtctggtacgtatttcaccgtttaatgcagccggtaaacgtcagacctcatttgtgtcctgcgatgttatgccggatattaaaaaagatctggatgttgagatcaatgatgatgatatccgtattgatacctatcgaagcagtggtgccggcggacagcatatcaacaagacatcttctgcgatccgtatcacacatttcccgacaggaatcgtggtacagtgccagaatgaacgttctcagcatatgaataaagataaggccatgcagatgctgaaagcgaagctgtatcttctgaaacagcaggaagcagaggcaaagctttccggtattcgtggtgaagttactgatatcggctggggaaaccagatcagatcctatgttatgcagccatatacgatggtaaaagaccacagaaccagtgaagagaccggtaatgtggatgccgtcctggatggagacattgatccattcattaatgcatatctgaaatggatcgctctgtcaaataaaccagcagagcagcagtaatcccggcgtgtgctgcgaacgaggtgagcagtaacacaaaatcagttttcagcctgtttggagcgacaaaaaatccttgcagagtgtgggctggtatgataacatatccctcgtagggaaacacgtgtccttgatatatggacatgcccgaagagggatatgtattattttggttacaagtagtatccataatgtgactgatatacactgtaaaaggattaaggactcaacaggaacaggaagattggaatggaaaaaacaacagagaagaaaaagtattttgtagtcagggagcgggcagttccggaagtattgttgaaggtggtacaggcaaagcgcctgcttgattcaggcagggcacagactgtgcaggatgcagcagaacagaccggaatcagtcgaagctccttttataaatataaggatgatatttttccttttcacgaagaggcaagaggaaagaccattaccttcattattcagatggatgatgaaccaggacttttatctgtagtacttcagaccattgcacattttcatggaaatattcttacgattcatcagagtattccaatcaatggaatcgcaactctcacactcagtgtagatattcttccgggagagggagatgcagaggccatggttgaagaaatcgaaagtcgggaaggaattcattatctgaagatccttggaagagaatagaaatttttttacacaggaggaagatatggttaatattgcggtattaggatacggtacagttggaagtggtgtcgtggaggttatcaacacaaaccacgaaagcattaataaacgggcaggtcaggagatcaatatcaaatatgttctcgacctcagagattttccgggagatccggtacaggaagttctggtacatgattatgagatcattgccaacgatccggaagtagacattgtagtagaagttatgggcggtattgaaccggcatatacctttgtaaagagagcgctggaatcaggtaagagtgtctgcacttccaataaagctctggttgcaaagcatggcccggagctgatggagattgcaaaagaaaagaacatcaacttcctgtttgaggcaagctgcggtggtggaattccgatcattcgagcacttaacggatctctgacagcagatgaagtcgatgagatcacaggaatcttaaatggaactaccaactacatgatgtacaagatggcaacagaaggttctgattttgatgtggttcttaaagaagcacagcagaagggatatgcagaggctgatccgaccgcagacgtagaaggttatgatgcatgccgtaagatcgcaatcctgtcttccctagcttatggaaagttcctgaattatgaaaatgtttatacagaaggaatcacaaagatcacaccggaagatatggtctatgcagaagaacttggcatgaccattaaacttctcggaaccagccgaaaactgggcgaggacacattcaccgcactggttgcaccgttcctggttggccagaagagcccgttatacagtgttaatgatgtttttaatgctgtttttgtacatggaaacatgcttggagatgccatgttttacggaagtggagcaggaaagcttccaacagcaagtgcagtagtggcagatgttgttgatgaagcgaagaatcttcatgaaaatattgcaacaaactggtcaaatgagccgatgaaactgactccgatggaggagacagagggaagatttttcgtaagagtcaaaggtgtgacggaagcacaggcagaagccgcttttggaaaacttcagattgtaaaagttgcttctcttccagatgaattcggattcattacagagtgcatgaaacagaaagaatataaagaaaagatcagtaaactgaatggtgaagtgatcgcaatgatccgtgtaaaggattgataaaatcgtattccgggaggaaactatgttaatagtaaagaaattcggaggtacatctgtagcaaacaaagaacgtatctacaatgttgccaacagatgtgttgaagaatataaaaaaggaaatgatgtggtagtcgttctttctgcaatgggaaaatatacggatgaactgatctccatggcagaagatattaatgaaaaaccaccaaaaagagaaatggatatgctctttacgattggagaacagatgtctgtatctctgatggcaatggcatttgacaaactgggagttccggcggtatcactgaatgcatttcaggtagctatgcatacgacaagtgtgcatggaaatgcccgcctcaaaagaattgatacagaacgtatccgcagagaactggaaaatcataagatcgtcgttgttacaggattccagggagtcaataaatacgatgattatacaactctgggaagaggcggttctgacacgactgcagttgctcttgcagcagctcttcatgcagatgcctgtgaaatctatacagatgtagacggagtttatacagcagatccacgtaaggttccgaaagcacgtaagctgaaagaaattacgtatgatgagatgctggatcttgcaacgcttggggcaggagtacttcataaccgttctgtagagatggcgaagaaatatggagtaccgcttgtggtacgttccagtctgaataacagtgagggaactgtcgtaaaggaggaagttacagtggaaagaatgctgatcagcggtgttgcgcttgatacagaggcggtaaggattgccgttatcggtctgaaagatgtaccgggtatggcgtttaaattatttgatgttcttgctaaaaaacatattaatgttgatgttattctgcagtctatcggacgtgcaggtacaaaggatatttcctttacggtagatggcaaagatctggatgatgcaattgcgactcttgaagaaaataaagccagacttggctatcaggaactgcattcagagagaaatattgcaaaactttctattgttggtgcaggaatgatgagcaaccctggtgttgctgcaaaaatgtttgaaagcctttataatgagggtgtaaacattaatatgatctcaacttctgagattcgagtaactgttctgatcaatgaaaaagatggtgtgagagccatgaatgcagtacatgatgcatttaatcttgcagactgatacaggatgtcgggatcattgcagaagtaaggaacagtaaaattcaaaatatgtaaattccatcttcggttttgcgaaggtggaatttttgtctgatgcctgaaaaaaggcagataggagaaaaatgactggacagagaaagtactggaaatcctatgcaaagagtaatctgaagggaaactgggggattgcaattgctgcaatgctggccgttgtagctgtaaattttatcggaaatatttttgctgtacagctgtttccgggagattccgtatttgcattggtattaagcgaaatttttgtgtttattgtatctctgataggaatgatcttcagtaccggatacagctatatgcagctgaatatctgcagaggcagggattacagcctgagtgatctgctgtatatgtttcataaccagccggacagagtactggttgccggactggtcgtagcgttgatcgacacagtggtgcagattccattctattatgtgacttatatggtaaatccgggagagactgtggaaagcatgattcactggtatcagcttctgttgggggcgtggcttcttgcaatggtattgagtgtgatttttacagtgccatttgcactgacattctattttctggctgatgatccggaaatgggtggtatagaggcactgaaagcaagtacacatgccatgaagggacatatctggcagtatcttatgttggaacttagttttgtcccactgctgtttttatcactgtttactctttatattgggctgctgtggctgatgccgtatatgcagtttacagaaactgcattttatatgtatgtaacaggagaactcgatcagcagagaactgaccggcagcatacgggaatccaggagatatctgaccgaaccggtgatgattataattcagaagcatagaacagaaaacaaaatataaaagatacaatgattatcatgcatgaaagaggagactataatggatattattcaggtgataaccaaagaacttaatgtggaaaaatggcaggtagaagctgcagtcaaattaattgacgaaggctgtactatcccgtttatttcccgataccgtaaagaagcaacgggttctttaaatgatgaacagcttcgtactcttcatgaaagactgacctatcttcgtaatctggaagaaaaaaagaatcaggtacttggaagtattgaagagcagggaaaactgacggcagagttgaagaaacagatccttgatgcacagacgctggtcgtagtagaggatctttatcgtccattccgaccgaaacgtcgtacccgtgcgatcattgcgaaggaaaaaggactggaaccgctggcgaatattattatgcttcaaatgacagacaagccgatggaagaagaagcacaggattttgtatcagaagaaaaaggtgtggaaacagtagcagatgcgatcaatggagccaaagatattattgcagagcacatttctgatgaggcagattatcgtatttatcttcgtaaactgactatggacagaggttctgttgtttctacagcgaagaaaccggaagaatcttctgtttatgaaatgtattatgaatttgaagagccgatcaaaaagcttgcgggacatcgtgtgcttgccctgaatcgtggtgagaaagaaaaaatccttacggttaaagtcaatgcaccggaagaagaagcaatgggatggcttcagaaacaggtcattacaaaagaaaatccaattacaaaaccgattcttcgcgaagtagtggaagacagttacaaacgtctgatcgcacctgcgattgagcgtgagatccgaagtgatctaacagaaaaggccgaagacggggcaatccatgtatttggaaagaatctggagcagcttctgatgcagcctccaatcgttggtaaagtagttcttggatgggatccggctttccgtacaggctgtaaactggctgttgtagatgagacaggaaaggttcttgatacaactgttatttatccgacagcaccgacaaatgatgcaaagatccgtgctgcaaaagaaacacttaagaagctgatcaaaaagtataatgtttctctgatctctctgggcaatggaacagcatccagagaatctgagcagatcattgtagaacttctgaaagaaattccggagaaggtacagtatgtgatcacaaatgaggcaggagcttctgtatattccgcaagtaaactggcaactgaggaattcccgaattttgatgtcggacagagaagtgcggcttctatcgcaagacgtctgcaggatccgctggcagagctggtcaagatcactccacagtctatcggtgtaggacagtatcagcatgatatgaatcagaagaagctcggagaggctctgagtggagtcgtagaggactgcgtaaataaagttggggtggatctgaatacagcatctgcatcccttctggaatatatttcaggtatcagtaaagtgattgcgaagaacatcgtggcttatcgggaagagaacggaagatttgaaagtcgtcgtgagcttctcaaagttgcaaaactcggaccgaaagcatttgaacagtgtgcaggttttgcacgtatcacaggcggaaagaatccgctggatgcgacaagtgttcatccggaaagctatgaagctgcgcagaaggttctggaaaaactgggatacaaaccagaagatatcactgttggcaaactgagtggtatttccagacagattaagaattacaaaaaactggcagaagagcttggcgttggtgaaccgacacttcgtgatattgtcaaagagctggaaaaaccggcacgagatcctcgtgatgagatgccgaagccggtactgagaacagatgtacttgatatgaaggacctgaaagaaggcatgatccttaaaggaaccgtacgtaatgtaattgactttggggcatttgtcgatatcggtgtacatcaggatggacttgtgcatatctctgagatgaccgagagatatatcaaacatccactggaggcagtgtctgttggggatgttgtagatgtacgagtgattggagtggatttgaagaagaagcgaatcagcttgtccatgaaggggatcaaataaagcagggaatctattttaatagcgggctagcagatgggatgaatgatgcgtaagagaaggatgtgtgtgcaggatgaatgtgcatgaatccctgaaacggcttcatcgcccggaaatactaagaatataccctgtctgttaaaaacatgaatcaaaagtgcataactcgcctgacggctcagacaatgcactttatgcttcataacacagactgggtatattcaagtatttctacggacgattgcagaggtttctggaattcatgcacattatacctgccattctaacatactggtacttacgcaaacatacatcccatctgcagcccgtttttacgttttcgcaagctttataaaagccccttgacctggacagcgctatttatagtatcgtgcggggaaaataaccggattatgcctatcaaagccatgctgtcgatttcctgctccttgctatagccttctgcggcgtgtggtcgggatccctccgggaaggaggcagctgagcgagatgggggaggaggtaaagataaaatatttggaatttaaaatagacttaagaatattatagaaaatatgagtggaatatgattggcgttattatagaaactatagaaggacttgagacaattttcttactgtgaacataaagtatattttttccaaattacagcaactaaaaaagatatatgattaattcaacatctgcaagaatcctggaagttcttaggaatgttccgagtgtgttattcataaaaatcacactgtttgagcgtcagcgagtttgtgatttttatgaatgtatttaacacgagggttattccttagtacttccggatgatgaagccgttgaaaaatcatatatctttaattagttgcgtgaatattaatagtaatatcaatagtaatattacttctttaatgtttgcgtaaaagaaaaaccatatcttttacgaaatccccatctcagctcagcagagcagaatcattggagaactcctgtccgctggctttctcaaactgatccagcagatttcttaccgtaagcttcttcttttcttccccctgaatatccaggataatctttccttccatcatcatgatcaggcggtttccgtgtgtaatagcgtcctgcatgttatgagtgatcatcattgttgtcagatgatcgcggtttacgatcatctcagtgatctcaaggaccttggctgctgttttcgggtcaagggctgcggtatgctcatcgaggagcagaagctttggtttctggagggttgccatcagcagagtaagtgcttggcgctgtccaccggagagaagtccgactttggaagtaaggcgatcttccagtccaaggccaagaatcttcagaagttctttatattcttcgcgttctttctttgtgattcctggtttcaggaaacgtgttttgccgcgacgtttagcaagggcaaggttttcttcaattcccattgtggcagctgttcctgtcataggatcctggaatacgcgtcccaggtaagctgctcttttgtgctcggataatttggtaacgtcgattccgtcaatgatgatctggccttcatcgaccatccaggtacctgcaacagcgttcagcatcgtggatttaccggcaccattaccaccgataacagttacgaaatctccctcgttcagtgtaaggttcagaccattcagagccactttctcattaatggttccaggattaaaggttttatatatattcttaagttctagcattatttgttacctccacgttttactggtttagaaaaatactttgctttccagtatggaacagcaaggaagactgcaactacaagtgcggacagcatcttcagaaggtctgtatcaatacccatccagataactgtctggagtaccagatagtagaggatagaaccaaaagcaacgctgagaagacgaagcgcaaagttatggaagatctttccaaagattgcttcaccgatgataactgcagcaagaccgataacgatagcaccacgtcccatgttgacatcagcaaatccctgatactgtgcaaggagagcactggaaagcgcaaccagtccgttggagatcataagaccaagaactttacatacatccgtattgattccctgtgcacgggacatattcggattacatccggtagcgcggagggagcatccaagttctgtaccgaagaaccagtaaaggattgcaatcagaacaacgataaagattgcaacgatgaaaattgtattctgataaaatggaacattttttacattacggagggaaacaagcagatcaaatttgtttccgtttactgcctggtttgcttttcccatgatcttaaggttggcagagtaaagaccaagctgagtcaggattccagcgaggatcgcagggattcccatgaatgtgtggaagatacctgtagcgagaccggcaagcattccggctccggtagcagcaagcatagaaacccacacactgtgaccgctcatcagcatcataacgcagacagcaccgccagtacacatggtgccgtcaacagtaaggtcggctacatcgaggatacggaaggtgagataaacaccaattgccatgattccccagatcagaccctgcgcagcagcgcctggaagtgcattgattaaagtaagaatattcatttttcagttcctcctgatagcacagaaagcgagaaaggataattcctttcccgctgcctgtataaatttgtaatgtttgattatcttcgaaaattattcagcctcttcggttgtttcctcttcagatgtctcgtcttttgctgcatcatcatcagaagcttcttcttcgtctgcaccgattgctacataatcatccggaacttcaataccgagttcttcacagatttccgggttgtattcttttgtgaactgtggagcatattcaattggcattttggaaatatcttcaccatctacaagaactttgagagccattttaccggtagcaacaccgaggtcatagtagttgatggaaagtgtggcaacaccgcatccttcacagataccttcttcacctgcgattaccggaactttttccggaagacagatgttgttgatgatctctgtattagatgcaacagtattatcagtcggaacatagatcacatcactctcagtagctgctgttgtagcaacagaagagaggtcgttggagtctgagaatgcatagtaagtacatgtgtaacctaatttctcaagagctgcttttactgtatcaacctgatactgggaattggcttctgctgaacagtagataagaccaacattttttgcatctgggaacagttcgttgagcattgcagcctgatcttcaagcggagcaaggtctgatgtaccggagatgtttccgccaacagttccatcgaaatcatccagatcaagtgctacaccgtattctgtaacagctgtaccaagaatcgggatatcagatgttcctgctgatgctgcctgaagtgcaggtgtagcgtttgcaagaatcagatcaacgtttttagaaacaaagtcggtgatgattgtagaacatgtattggaatcaccctgagcgttctgctcatcgaaagttactttatcgccaagttcttctgtgatcgcatctttgaatccctgtgttgcagcgtccagtgcttcgtgctgtacgagctggcagataccgatgttgtatgttttatcatctgctttatctgctgcaaatacgctgacaccacccatgccaactaccattgttgcagacagaatgcctgctaaaatctgctttttcatatttttaaacctcctgattttactgattcatgttcgaatcaaattaactttctaaagtataacgctttaacgtgaaaaagtcaagaaaattattatttcctaattaatatacaaaaaaaattaggttatcaaataaatagtacgttttttgcaaatttattgacaatttaaaaagtgccatgtatagtaaaagtacttgcaaagaggcgtaactgagaaagttgtgcctcttttgttccgcaacaggagtaagagcacagaaaacggaggaaagaagaatgaaaaaagcattggcaattggacttgcagcagctatggcagttactatgactgcacctgtatacgcaagtgacgacagcgaaagtggcaaaggtattgcaaaggaagacctcaagattggtgcaatttacatcggcgatgagaacgaaggttacacagcagctcatatggctggtatcgatgaaatgcaggaggcacttggccttgacgattcacaggttattgaaaaaactctgatcggtgaagatgagggatgctacgatgcagcagcagaccttgcagatcagggctgccagatcatttttgcaaacagcttcggacatgagacttatatccttgaagcagcaggggaatatccggatgtgcagttctgtcatgcaactggaactcaggcagcatcaagcggactttccaatatgcacaactacttcacaaacatttatgaagctcgttatgtgtccggtgtagtagctggccttaaactgaatcagatgatcgaagatggaactattacagaagatagctgcaagatgggttatgttggtgcattcccgtacgcagaggttatttccggatatacttctttctaccttggcgcaaagagtgtatgcccgtccgtaactatggaagtaaaatatacaaacagctgggcaagcttcgaccttgaaaaagaatgtgcagatgcgctgatttctgatggatgtgttctgatcagccagcacgcagatacaacaggtgctccgacagcatgtgaagcagcaggcgttccttgcgttggatacaatattgatatgacatctgttgcaccgaatacagctcttacttctgcatctatggactggggtgtatattacacatatgcagtacagtgcatgcttgatggaacagcaattgatactgactggtgcaaaggcttctccgacggcgctgacaagatcacacctctcaatgagaaagttgtagcagaaggaacagacgaaaaagtaaaagaagtggaagatgcacttgcagacggatcccttcatgtattcgatacttctacatttacagtagatggcaaagaacttactacttataagaaagatggcagtgatacagaatatgtttctgacggatatttccatgaatcagaatatggttctgcaccggcatttgatgtagctatcgatggaatcacatctatcacagaataagatctgaaacaggcggagctgctgggtcagcagctctgctttttttcttgttatacgtgcaaaggaagtcttcagggcggaggtttcttttgcagatatgacaatatatcagataaaaggagggaacgatagtggaagaaacttatgcacttgagcttagagatatttccaagcgatttggatcagttcaggcgaatgaccatgtaaatcttacactgaggaaatcagagattctcgcaattttaggtgagaatggaagcggtaaaacgactctgatgaatatgatctatggaatttattatccagatgaaggtcatatttttgtaaatgggaaggaagtaaaaatccgttcgccaaaagactcctatgaattaggaataggtatggtacatcagcatttcaaactggtagatgtacttacggcagcagaaaatattgtattgggcctgcctggtaaggccagactcaatatgaaaaaaataaccgaagatattcagaaactggtcaataaatatggttttgatctggacctttccaaaaaaatctacgaaatgtccgtttctgaaaaacagacagttgaaattgtgaagatgctgtatcgtggagcaaggatcctgatcctggatgagccgacagcagtgttgacgccacaggaagccgacaggctgttcgatattcttcgaaacatgcgtgacgatggatgttcgatcattatcattacccataaattgcaggaggttcttgctttgtctgaccgcgttgcaattcttcgaaagggtcagtatattgacacggtagagacagcacaggccaatgtgcagagtctttcagaaatgatggttggagccaaagtagatctgaacatcgaacgtccgaaacctgaaaatgtaaaaccgcgtctgatcattgagggaatcaactgtaaggacaaagaaaatgtcaagacactggatgatgtggatctgacagtcaatacaggggagattcttggaattgccggcatttcaggaagtggacagaaagaacttcttgaggcgattgcaggactgcagaatgtagaaagtggttccatacgtctgttggatgataacggaggcgaaatggaactttccggaatggattcaatttccattaacgaagcgggaatcagccttgcttttgttccagaggatcgtattggtatggggcttgtcggtgatatggatatgacggacaatatgatgatccgaagctatcgtaatggaaagggacctttcctggatcgtaagggacctagagcacttgcagagaagatcaaagatcagctggaagttatgacaccaagtatttctgcaccggttcgccagatgtcaggtggtaatgtgcagaaagttctggtaggaagagaaatcgcacagaatccaaaagttcttcttgtagcatttccgactcgaggtgtggatatcaatacctctcatgttatttatcagcttctgaatgagcagaagaaaaaaggcgtagcagttgtctgcgtaattgaagatcttgatgtagtacttgaactctgtgaccgcatcgcggtactgtgtggaggaaaaatcagcggagtggttgatggcagaactgcaaccaaagaaggaatcggtcttcttatgacgaaacatgaaaaaggaggggttgtcaatgaataaagaacctttcttacaggtaagtaaaagaagaaacaaagccggatggcaggaaagactgctgattcgatttattgcgctgatccttgcactgatcgtgtgcggtgctgtaatcgtcgcacttgtcaagatgaatccggtagatgtatataaagcaatctgggatggagcaatgggatcggaacgtcgtatctggcagacaatacgtgatacgatggttcttctgtgtattgcaatcggacttgctccggcattcaaaatgaaattctggaatatcggtgcagaaggccagatcctgattggtggagcctgctccgcagcggtgatgatctatgcaggtgataaaatgtcaccggtgatcttacttattgttatgtttattgcaagtgcacttggcggcatgatatggggtatgatcccggcggtattcaaagcatactggaatacaaatgaaacactttttactctgatgctgaattatgttgccatgcaggtggttacatattgtatcgttttctgggaaaatccaaaaggttccaatactgttggtatcattaatcaggcaacacaggcaggctggctgccggaactgtttggacagaaatacggctggaatgttctgatcgttctgatcctgactgttgggatgttcatttatctgaaatactgcaaacagggttatgagatcgctgtagttggtgagagtgaaaatactgcaaaatatgccggtatccatgtaaagaaagttattatccgtaccatggcaatctctggtgcaatctgtggtatcgcaggatttgttattgtaagtggtgcaagccatacaatctctactgcaacagcaggaggacgtggatttacagcaatcatcgttgcatggctttccaaattcaatacttttattatggtggctgtatcttttggtattgtatttatgaatcagggtgctgttcagattgcgactcagtatggattgaatgaaaatgcatccgatgttattctcggcattattctgtttttcctgatcggggcagaattctttatcaactacagagtaaagcgtacaaaaaaataggaggtagatgcaatgagtgtactgaccatctttattcaaaaagcaattgtccagggcatctgtattctttatggtgcgcttggtgaaattatgacggagaaatccggaaacctgaatcttggtattccgggaattatgtatatgggcggtattgccggcctgatgggagcttttctttatgaaaaagataacccgaatccgaatgcatttataggtgtcctgatatcgtttgtatgtgcctttgcatgtgcaatgatcggtggcctgatctacagtatcctgaccattactcttcgtgtaaatcagaacgtaaccggtcttgctcttacaatctttggtacaggttttggtaacttctttggtggttctatttccaaacttgccggtggtgtcggacagatttctgtaaaagtaacaggaagtgcttacacagccaaaatcccgggattatctaagattccggtaatcggaccgattttgttcaattatggatttatgacatatctctgtgtgatcgtagcggtggttttgtctttcttcttatttaaaacaagagcaggcttgaatcttcgtgcaattggcgagaatcctggaacagcagatgcagcaggtatcaatgttatcaaatacaaatatctgtctacctgtatcggagcagggcttgccggacttggcggactctatttcgtaatggaatattccggcggaacctggacagacaatggatttggtgaccgtggatggcttgcagttgcactggtaatcttcgcactgtggaaaccactgaatgcaatctggggagcgttccttttcggagcactttatatcctgtatctgtatatcccgggactgggacgaagtatgcaggaggtgtttaaggcactgccgtatgtggtaacgattattgtactggtgtttacaagcttccgaaagaagaaggagcaccagccgccggcgggacttggattaccgtatttccgtgaggagagataataaaggattcccggtgattatgggataattaaatgaaccagatgggattttcgataaatgttcctctggatacgtctcaattcagaacttctaaggtaccaaggtgtacagaactttgctaagaacaatacagaaaatactttaagcatatccttctttctaaaatttatattgcattattataaagttagttatataatacagaaatataaaagaaaattcttcggggcagggtgaccgacgcagttggaattccctaccggcggtaaagtccgcgacccgcgtaaggcggctgatccggtgactggcacaagtcagaattccggaaccgacagtaaagtctggatgagagaagaacacgaataattcatacgtgctcagtaccccgggaagattattcccgggatttttttatgcagcagaaactaatctccccactaaacttatctgcagcatagcgtagaattttcttttagaaaaaaagaacaattcaaaaaggagagataagtatgagtgaacaggttttaaaaagtggaaacgtaatggagaggagtcgtacaagaacgatcacacagatcgcaatgcttggagccctcgccggaatattaatgaattttgaattcccgctcccattcctggcaccatccttctatcagctggatttctctgagattccggtactggtaggagccttcgcaatgggaccgatcgcaggtatcctgatcgaagtggtaaaagttctggtgcatcttgtaacaatgggaactatgacagcaggtgttggtgattttgcaaacttcctctttggatgtacatttgttgtaccggcaggaatcatctacagactgcatcataacaagagtcgcaaacatgccgttattggaatggcagcaggtacagtactgacaacagcagcagcctgccttatgaatgcatttgtactgcttccggcatatggcaaagcatttggtatgccgatcgaagcatttattgaaatgggatcagcagtacatccttctgtaaacagccttcttggttttgtagcattgatcatcgttccatttaacttatttaaatatattctgatttctgtaatcgtattctttatttataaaagaattcgtgttatccttaagggagactgattcaggcacagcagacagagtgtgcagaaaagaggaaacccatgggaaagattcataatgtagaaaaaatgacagataaccgttttgtcaatctgtatcatgtggatgctacaagtgttcacaataccccggtgtcttattacgtggcatccagagcaaaggatgttccggcgctgaaactgaagaccggacgtaatgatccggatggtgtgatcatttatagtatctatggacaaaagaaggacaaggttgttctggtacgccagtatcgttacacattgggcgattacatttatgaatttccggcaggtctggttgagccaggcgaagatttccatgaaggtgcagtccgtgagatgtatgaagaaactggtcttaaactggaacctttgaaagtagatcctgcattcgaaaagccgtattttacaacagtaggtatgacagatgaatcctgtgcaactgtatacggctatgccagcggtgagatcagtaaggcagcacaggaagacagtgaggaaattgaaatcgtactcgctgaccgtaccgaagtaaaacgaatcctcaaagaagaacgtgtggcaattatgtgtgcctatatgctgatgcattttttaaaggatgaggatccatttgagtttttgaactaatatagctgaaatgtcatgaccgccttgtgtggattgacatttcagtttttttttacacatgaatgtgaggcgttaaagatgaaagaaataatggattttttaaaagaggaaggaatcagtccgaagctgattcaggaggtacaggagttttctgcggctcatccggtgaaggaggagctgaatggaaggattcctgtacctcatttttattattatggcaaaaaagtgtgggaggaagccctggcagcacttttgtgtggaaagaatctattgctttcaggtgaaaaagccacggggaaaaatgtacttgcggaaaatctggcagcagttttcggccgtcctgcctgggatatctcatttcatgtcaatatggatgcgtcttcgcttatcggcacggatactttcagaaacgggaaggttgaattcagaccaggaccagtatacagctgtgcgtgcaatggaggctttggtatattcgatgagatcaatatggcaagaaatgaagcacttgcagttttgcattctgcattggatttcaggcgggttatagacgttcccggatatgaaagaataactctggcagacgatactcgctttattgcaacgatgaactataactatgcaggaacacgagaattgaatgaagcacttgcgtcaagatttgtagtgatccgtatgcctgcacttacactggaagatctgcagaggcttttaagagaacagtttccagatctttcttctaaatataataagcagtttggattactttttatggatatccagaaaaaatgtgaaagtggagaactgacttcaaaagcaatggatcttcgtggactcttggatgcaatcagcctgatgcacaaaggaattccagtcagagatgctcttgatcttggcgtgacaaataaaatatttgacagttatgagcaggctctgctcagcgatgtgatgaatgccaggatttccatgaaactcaaagcttcggaggtgtttgatggatgaccggatcttatacagaagtacagagacgggccgccaatcagatttggggtgctgctggtcattatgattttgaaccaatgtttctggcaatacacagtcaggaaaacaggccggatttttatatgaatctggtcataggacttgcatataaatattttggcgaaaagacacttacagaactttttgtgcgatggcagggagatagccggcagcagatgctggatgatctggcctggctttatatagaaccgatcgtgtacaagcttgaaattccgattagaccggcactggaagatgtgcggatggattacgcagaagctttttttgcaggagagtataagctgtcacggcaggaatggatgagcaaaaatcaattggtatataccctgcagtctgccaggtggagcagagtatcaggcagaaaacttccagtgatgacgccatttgagaaaaaattgcttttggctctgactccggaaaataaagtgtcacaggaagaaattatagagaaactggtaagtatttacaaaactttttatttatttgatgggaaaaagcatatcagaaaaccattaatgctccattttactggaacagcggccaggctgctgactcgaatcatgccggctcaactggtaaagacagaccgggttgtggtaatgcgttcttcacaggctgacagcagccagaatggaatcatgcagaataaaagcagcagtcatatgatcttaaaaaaagaagaaaccgatcatgcatatatagaaaactgctttggaaggtcactgtattcaaaacaggaactggcaaggaccgagaaagaactctgtaaaggaaatcacgcaggctgccacgtatggtttacggatggaaaatatattccaaaagagaaaatatcagcagaaaaccgttatctaagaaatcaggcacagcttcagatggaaagaaacagaatatattattataaaaatcaaaaactgtatcagagtattatcgcacagctttcgtcacagataagaaattgtatgatggttcatcagcagccggatatactgcctggcagatctggacgcctggatcctgcgagagtgtggagatcggaatatgtcatggataatcgggtctttcatgctaattatgaagagaaaaagccactgtttacggtggatcttcttttggatgcgtctgcgtcaagattacagtatcaggaaatgatcgctgcgcagggagtgattctttcagaaagtcttcaggcatgtcatattccggtcagagtttcggaattctgcagtgtacgcggatatacagtgcttcggattctgaaggcatttgaggagaaaaaaagtgatgacgtttttcgatactttgcaactggctggaatcgtgacggacttgtcatgcgggagatgaatgaacttctgagatcccatagtgaatcagctgaccgtcatctgcttattttactgacggatgcggaaccaaatgacagttttcgtatacagtcttcagaacagtttccatttggaaaggactatggagatgaggcagctgttaatgatacagcggctgaagtgcgggcattgcaacgaaaaggcatctgtgtttctgctgtatttatgggaacggatgcaggcgcattgaaggcagaaataatttatggaaaagaatataccagaatacaggaggtcggacagttggccagggcagcaggtttgctgatccagaaggaaataagtaaaattgatttataaatatgataaataaataacaaagatgttatggaatagacaaataaaattgtatacaatattcctgtatatttataagaataatagacaaatttaacaataactattgttttttaaacgagaagttttataataataattgctaagcagagtgtatggtaagctgatctgccatactttgacaaaaatatgacaactgtgaattgcagtagagggagggatttaaatgatcagttttattttgtgtctggcacttctgattatcggttactttacctatggtaaggtcgttgataacacttttggaccagatgatcgtgaaaccccggcggtaagcatcaacgacggagtggattatgtagtgatgccacagtggaaactgttccttgtacagcttcttaacattgcaggattgggacctatttttggtgcgatgcagggtgcattgtggggaccaatcgtatttctctggatcacgtttggtacaatttttgccggcggtgttcatgactacttctctggaatgatcagcgaacgtaattcgggaagctcagtagcagaatttacaggtaaatacctcggcggtgttatgcagaacatcatgcgagtattttcagtagtactcctgatcatggttggtactgtttttgcagtaggtcctgcaggtcttattgttacactgtgtaagaatggcgggctgtcaggtgttcttaccactacactgttctggcttattcttattctggtttattattttattgcaacatttatttccattgataagatcatcggtaagatttacccggtatttggtctctgcctgatcattatggcagttggtgttatcataggaatctatacaaaccctgaatttacgattcctgaaatctggagtcatatgtacagtatgcatccggcaggaacaccaatctggagctttatgtttattactgtagcctgtggtgcaatctccggtttccattctacacagtcaccattgatggctcgttgtatgaagagtgagaaacagggtcactttgtattttatggtgcaatggttgctgagggtatcattgctctgatctgggcagcagcaggatgtgctctttatgaagttacaggcggactgaatacaggtcttgcagaaattctttccggtggccagtcagcagctatctatgatgtatgttccaagacaatgggtggtgttggtattgcacttgcgatgatcggtgttgttgtatgtcctattacttcaggtgatacggctttccgttcagcaagacttactctgtctgactggttccatattgatcagggaagatacgctaacagactgaaactttgtattccggttcttggtgttggcgctgttcttggtattggtaatgcagttggcgcaattgactatacagttatctggcgttattttagctggacaaaccagacacttgcaatgatcgttctctgggcagcatccatgtatctggtaagtgaaaagaaaaacttctggatcacagcagttccggccacttttatgagtgcagtttccagtacatatttcatccttgcaccggaatgtcttggcggtctgatcaattccaaaacggcagaaggcgcagttgtttataatacagctgtagcttatccgataggtattatttttgcaatcgtacttcttgttattttccttcgcgcagcgaagaaacatgcagctgcctgaaactattttaagtgaggtctgatatcatgatttttaaaccacatccacttagtacatctcagcttccggcaccggaacttgaggaagacagaaaatcctgtcgtaaggtcggcccctgtgggatcggaaagaaagcaatttacctgaacagcttttatgtagacaggtgctattatattccttttacggcggtccgacgcgtctttaaacgcgtggctatgagtaagggtggattttctggaaaaggaatgtttgccagtattccgtatctggttgtggagtatgatgacggacagcagaaacaatgcaatttcaaatatgaaaatcaggtagatgatcttttgaaactgctttcagctgagcagccacagatacggctgctcagtgaggccgcggaagcgaagctggaaaagcagaaagcagagaaagaacgggagctgcgttccagaccggaaataaccactcagtcacaaaaagaagtggcaaagcttcagagggccattgattacctggaccagaaacctcagttaagtgagaatctgagccgggcggcgggaagacgacggacctatcagtgcacaagcccaagctatcgctgggtggcaatggcaattactatgctgggatttgtagcagtggcggcaggaatttattcatttattgtacacaatgattttgcagtatactttcttttgtttggtatcgctgctgtttttacttttgccggtttcagtgttctgccaacggcacgtaataatcgaaaagcaatcatgagccaggatgaacaggcacgaaagcaaatggaagattacgttaaaggttatccggattttccggtacctgccagatatgctcacccgacggtactgaaacggatgcagagagtgatcgaacagggacgtgcagaagaaaaaggccaggcacttgaaattgtcaaggaagatctcaaagcattgaacagtgatgtgaaagtatcgcaggaagaatatgatgaggtagttgcgattaagccaatgtttttgaatgctatgtatcagtaaagctgctgtgaacggagtggacagtaattcagtaaaaatagaatcagtaaaaatataaaatagcgggttgacaagttctgggctgacgtgttatattttcatcagttgtagtgtgtaactcgatttcaggaggcattaactatacataactaggagtgtttatgtatattagtgcctttttttgtacaaaagttgctgtaaacagtaacaaaaaccggttgattaaggcacttatgcatactcacttctaccaaatatatagaaggagagtgtcagatgaaagacaagatttttggtgttttacagcgagttggacgaagcttcatgctcccgatcgcaatccttccggtagccggacttcttcttggtatcggaagttctttcaccaatgcaacaacgattgagacatatggcctgacaaagattctgggtgacggaacactgcttcattccctgatggtgatcatgaacagcgtaggaagtgcagtctttaataacctgccactgatttttgcagttggtgttgcaattggtatggcaaagaaagaaaaagaagttgcagctttatcagcagttatcgcatttttcgtaatgaatacagcgatcaatgcgatgctgacagttacaggacagattcttgcaaatggagagatcgcagaatccgttcttgagggaacgatcacttctgtctgcggtatccagtcactgcagatgggcgtttttggtggtattatcgtaggacttggagtagcagctctgcataataaattttacagaatacagctgccgaatgcactgtcattttttggaggtacccgtttcgttccgatcatttccacgatcgtctatatgtttgtgggaattcttctgtattttgtatggccggtagttcagaacggaatctacgctctgggcggtcttgtaacaggaaccggttatgttggaacactgatttttggacttattaaacgtgctctgattccatttggtcttcatcatgtattttatatgccattctggcagactgctgtcggtggtacaatggaagttgcaggacagatggtacagggcggccagaatattttctttgcacagctagctgattctgcaaatattgcacatttcagtgctgatgcaacaagatatttttccggagaatttatttttatgatcttcggtcttccgggagctgcactggctatgtatcagtgtgcaaaacctgagaagaaaaaacaggcaggaggccttcttctgtctgcagcgcttgcatgtatggcaaccggaattacagagccgctggaattttcattcctgttcgtagctccggcactgtttgctgttcaggtagttctggcaggtagcgcatacatgatcgcacatatgctgaatattgccgtaggacttactttctccggtggattccttgatttcttcctgtttggtattcttcagggaaacgcaaagacaagctggatgagagttatcccggttggtattatttatttctttttatattattttattttcaaattcatgatcaaaaagtttgatttcaaaacgcctggtcgtgaggatgatgatgtagaaacaaagctttatacgaaggctgatgtaaatgcccgcaaagaggcacagaatggtgctgttgaagctggttcttctgatccggtcagcgaggcaatcacaagaggtcttggtggtaagaaaaatatcagtgatgtggactgctgtgcaacacgtcttcgttgtacggttaaggatgcatctctggtaaacgatggtattttaaaggcaacaggtgcatcaggtgtggttcataagggacttggcgtacaggttatttatggtccaaatgttaccgttatcaaatcaaatcttgaggattatctggaaacagcaccagatactctggaaacaccggcggaaagtgttgaaacaccggaagtaagtgagcagaaagaagatgccggacagaaagttgtcgaccgcattgtgatttccagcccgatcactggtgtagcggctgagctctctacagcaccggatgaggcatttgcccagaagatgatgggggatggtgcggtagttacaccggaagatccttatgtacgtgctcctgaagatggagaagttgcctttgtctttgacacaaaacatgcaattggatttgtaacagaatccggaatcagtcttctgattcatgtgggaatcgatactgtaaaactgaatggtgagggatttgaggcactggtagaaagcgggcaggaagtgaagaaaggagatccgatgctgaaactggatctggattatctgagcaaaaacgcaccttctattgtatcaccggttctttgtacagagctggaggataaccagagaatccatctgttaaatgagggtcaggtcaaagcaggagagccgcttttcgaaatcgaggttcttcagtaagaactacccggatggggaagagatacggatgttgtacaggatagcaaaaattttaaatcataattcctttatgggaatccaggatgaaaataaccaggaatgtctggttatgggaaaaggagttgcttttggcaagaaagtgggacaaactgttccggtcactgcggaagcaaaggtttattcattgaaagaaatgacagagcgaggagaggcaaaagatatcctcaaatcggtttcaccactttgtctggagtttgcaaacgaagtgctgaatcaggcggagcaggaatttggcaaagtagaccggacaattctttttaccatggcagatcatctggactttgcgatccgccgcattcagaatggagagcagatcagcaacccgctgactgatgacatccgtgttatgttttataaagaatataaagtagccagttgtattcaggaacttctgaaggaaaaacttcagttggagatagatgaacatgagattggctatatcgccctgcatgtgcatgctgccatcgtagatgaaaatgtttcccaggcaatggagattgccagaacagtccgcgaatgtatttctcttgtagagaaagaaaccggaaattctatcgacgtcatgtcactcggatacaatcgtctgatgaatcatgtgcgctatatggtagcacgtgcaatccatggtgagaaattaaaaatgaatctgaatgaatatatgtccgtaaagttcccggaagcatttatggcagcagagcgaatctgccgtcagatggaaaagagcctgaagcttccgattccggacattgaaatcggatatcttgccatgcatctggaaagaatgttagatacggatatcaatgagtaagatataaagttaaatgtcactgtcgaaggtaactgtaggataaatataaatacaaaaacataatataaaaggagaacaaaactatgaaaacatttgagtatacaattaaagacgaacttggaatccacgcaagaccggcaggacttcttgtaaaagaagcaaaaaaattcgaatctgaatgcaccatcacaaaagacggcaaaacaaaaaaactcacacagcttatgatgcttatgtctcttggtgtaaaacagggtgacactgttactgtaacagcagaaggcgctgatgaagaagctgcagctgctgcattaaaagaattctttgagaataacttataattcgctggaacgaccagaatcagtttacatttgaattcagggaggaaaaggaatgcagtgttttcagggaaaatctgtatataaaggaatcgcgatgggaccgatcgtggttcttaagaaaaatgattatcaggtaaaacgtacccgtatcgaagatacagaagcagaagtaaaacgtgtggatgaggcattaaaagcatctcaggaacagctgcagaaactgtatgacaaggctgtcagagaagttggcgaagccagtgctgcaatcttcgaagtacatcagatgatgctggaggatgaggattatctggaggcaatccagaatatgatccgtacagaacaggtcaatgccgagtatgcggttgcggttaccggcgataatttcgcagagatgtttgcttccatggacgatgattatatgaaagcacgttctgccgatatcaaagatatctctgaacgtcttgtacgtaatttaagtggacagggagatgtggatttaagcgaaatcgagccatctgtaattgtagcggatgatctcagcccaagtgagacagtccagatggacaaagataagatccttgcatttgtaacagttcacggatctaccaattctcatacagcgattcttgcgcgtatgatgaatattccggcactgatcggagtaaaaatggatctggaagctcttcagagtggagtgacagcggttgtagacggtttccagggaatggttacttttgacccggatgaagagacaaaagcacagactgaaaccaaaatacaggaagaagctgagaaactgaagcttcttcaggaactcaaaggcaaagaaaacattactctggacggacgtaagattaatatttatgcaaacattggaagcgttggcgatattggttatgtgatggaaaatgatgccggcggaatcggacttttcagaagtgaattcctgtatcttggaagaaacgatttccctactgaggaggaacagttccaggcttacaagcaggcagtacagatgatggcaggtaagaaggttattatccgtacattggatatcggagccgacaaacaggtagattatttcaatcttggtaatgaagataacccggctatgggataccgtgcaatccgtatttgtctgagacagccggaaattttcaaaactcagcttcgtgcacttctccgcgcagccgtttatggaaatctttctatcatgtatccgatgattacttctacagaagaagtaaagaaaatttatgagatcgtagcagaagtagaagaagagttgaaagcacaggagattcagtataagattccggaacagggaatcatgattgagactccggcagcagcgatcatcagtgataaactggcagagatggttgatttcttcagtattggaacgaatgatctgacccagtatacactggcaattgaccgccagaatgaaaaactggatgagttctataatccacatcatgaagcaatcctgcgtatgatccagatggttgtggacaatgcgcataaatgtggtaaatgggcaggtatctgcggagaacttggagcagatgcaactcttaccgagcagtttgtacgtatgggactggatgaactctctgtagcaccatccatggttctgaagcttcgtaaaatcgttcgcgagatgaaagtagaagaataagtaaataagaaaaaatatcaaaaatgaaaaccgttttcatattgacactctatcagaatgtgctataatatgaaaacggttttcattttgggtaaaaagaaggaagaaattatgggaacgaaagcaccttatcagacaaaacaaatgaaacagatactggcttatcttcagacgatagagggtacacatgtgacggccgcagatgtctgctcctatttcaaagagcagggaatcaatgtcggaacaacgacagtttatcgtaatcttgagaagatggtagaacagaggcttgttgccaagtataacgtggatgggacgagcagtgcctgttttgaatatctcggagcagaagaacattgtcataagacctcctgtttccactgcaaatgtgaaaaatgtggaaaactgattcatcttcactgcgaggatgtggttaaactggagcagcacctgatggacagtcacggatttcgcatggatccgtgcagaacggttttttatggaatctgtgaagaatgcagaggactggaagatgacaaaaaagaaacagagactgtacatatcagggcaaaataagcggaatataaggtaacggagtagaatgctgagacagaagaaagcaggtataaggatgaaaaaatggatcactggtgcgctagcaattctgctgggtgtgatgagcattgcgattcctttttcaggaatgcacatagcagaagctaaaacaacggaggaaacagacaggaaactgaatattgtgacaaccatttttccggaatatgactggacaagaaatattctggggaacagggaagcggatgtgaatcttacgatgctcctggataatgggacagaccttcatagttttcagccggcagtgaaagatattatgaaagtatccagctgtgatctcctgatttatgtgggtggagaatccgaccagtggattgaggatgcactggaatcggctcagaataaagatatgaagacgattaatctgatggaagtccttggcgatacgattaaggaagaagaaacagttgagggtatgcaggacagtgaacacgaacatggtcatgaggacgagcatgcccatgagggtgaggatgagaaggaatatgacgagcatgtctggacttccatgcgaaatgcttctgtgatctgtgacgcgattgcagaaacgcttgaggagatggatcctgagaataaagaaatctatcagacaaatgctgagaactacaaagcaaaactttctacactggatcagaaatatcaggaaacggtagatacagacagacagaatacgctgatctttgccgatcgttttgcatttcgttatctggtcgatgattatggactgaactattatgcagctttttccggatgctctgcagagtcggaagcaagcttcaagactgtgacttttcttgcgggtaaactggatgaactgggaataaaaacggtattgacgattgagaagtccgatgacaggatagcacagaccgtgattgaaaatacaaaaaagaaagatcagaagatcctcgagcttaattccatgcagtcgatcacttcggatgagattaaaaacggagtgacatatctttctgtgatggaagataatctgaaggttctgaaagaagcacttaagtaggaaaagaggaacaacaatggcacagcttacatgtaaaaatcttacattgggatatgataaccgggcaattcaggaagacctgaatttctctattgatgcaggtgattacctttgcatcgtaggtgaaaatggttccggtaaatctacattgatgaagacacttcttcatctgcaggcaccgatcagcggcagtattgaactgggagatggcctgaaaaaaaacgaaattggttatctgccgcagcagacgctggtgcagagagattttccggcatccgtgagggaaattgtgttatctggatgccagagtcgttgtggatggagacctttttataacaaagaggaaaaaatggttgcccagagagccatggaaaaaatgatgatccaggatctggcagatcagtgctatcgcgaactttccggagggcagcagcagcgggttcttcttgcaagagctctttgtgcagcacagaagatcctgcttctggatgagccggtttcgggacttgatccgagagtgacagcagagatgtaccagctgatcaggaatctgaataaaaaagatggaattacgatcattatgatctcacatgatattgcggcggcagtaaaatatgcaacacatatcctgcatatcggggagcattgcttcttcggaacaaagaaacagtatctggaaagcagtctgggaaaggcgtttactggacaggaaggagaggacgaataagatgtttgagacacttcgtatgtattttcaatacccgtttgtgcgttatgcattgatcgttggggtactgatcgcattatgttcttcacttctgggcgtgactctggtattgaaacgtttttcctttatcggtgacggactttctcatgtggcatttggggcaatggcgatagcatctgtcctgaatattaccaacaatatgctgtttatcctgccggtaacagtaatctgtgcgatccttcttcttcgtgctggtcagaacacaagaatcaagggcgatgcggcgattgccatgatctctgtcggagccctggcaatcggatatcttttgatgaatcttttttccaccagcccaaatatctccggagatgtatgcagtacattgttcggctccacatcgatcctgacactgacaaaaggcgaggtatggctgtgtggaatcctttctgttgtggttgttgctatttttattcttttttataataaaatttttgcagtaacatttgatgagaattttgccagagcgaccggaacgagagcgaatgcctataatctgctgattgcagttgtgattgcagtaatcattgtacttgcaatgaatctggtaggttcacttctgatttcagcacttgtaatttttccggcgttgtcagcaatgcggttgtttaaatctttccgttcggtaacgatcagtgcggcagtgttgtccgttttaagtgctactgccggcattctgatctccattctggcaggtactccggttggctccacgatcgtggcagtggatattgctgtatttctgatttcttatggcattggaaggattacgggaagataaaaatatctcagccggagctggatccccgactgagacagtattttaaaaatgttggtttataacaggaattcttgtagaactcagatttctacgaggattcctttttctttgtcataatggcagtatttgccatttgcggagatgaacggctgatatgtatcggtacgggtgtctttgacatagacaacaccggttgcgatcatctcaacaagagagaaacgtttgctcaggctggaaatccacgcataggtcttctcgctgtcagagtcagctgcaagcagactgtaaccgccgtcacaggctttgagagagaaatagattttttcaggttttacaatttccttgaaaacctgactggtaatgtaagaagagaaattctcctttacaaatttctggaaggttttcgtggtataaacttctccggatacttcatcagtgattctgtctccacgctccagacggttcttgatcagagtcagaacttcgatcgtccagttgataaaggagatactgctgtaggtcatgctttcctgaagctggtcgatcagcttttttgtcaggacatttgatttggccgcttcgttaaaaagttcttcgttcataatgttccctccataataaatgtatgtggtaattgataatttttattataaagtgcagttgtgcaaaaagcaatgaaaaacagatgaaacatcataaaaattgtataaaatacacatacttagcacttgctgttgcttgaaccacatattttgaatatgttgcagaaaaatagggaatcagttacaatagaatcaggtgtgaaatcagaattcaaaataaagaagagaataagatctgccggcagttcggggcaattgatgggatggaaacagaatgaagaaggataaagataagaaactgacttattttttgagagccgcgatgatggttctgacaacgatattaatcgtattgtttcttgtgatcatgtcgatggtgggcaaaatacagggaacagccagggttgtgaattatgcgggacttgtccggggtggtacacagaggatggttaagctggaaatctccggtgcaccgcaggataagatgtatgagacgatttcttcttacatagaggggctccgaaatggcagtgagaaactgaattttgtacgtctggatgatgaagatttccagactaagatggatgaactggaaaaatattttgatgaattgagaagtgaaatcctccttgttcgcgagaagggttatgagaatacagaaattatagaaaagagcgaaaaatttttccagatctgtgatgaggcagtaggttttgcagaagtctattcacagaaaaaagcgaccggactggatcatctggaaaaaatcgtattggttgatattctgggactggtattgatcattgctacggaactgataaaggtggtacgttttgctgcacagaataagattttgcagaaaaaagtctatctggatgaggcgacaggccttccaaacaaaaataagtgtgaggagatcctgaatgagacggagccgataccggtgaatgagctggtggcaatgtgtgtgtttgatctgaacaatctgcgaacgatcaacaacaatctgggacatgacaaaggggatgagtatattcgctcttttgcaatccagctccgtgaggcggtaccggaagaattttttgcaggtcgtgatggtggtgatgaatttattgcggttctgaagggactggaccatgagggcgttcggaaatgtctgcagaacatccgcaaccaggctgcagaatattccagacagcatccggaaatgccaatcagctatgcagccggttatgcactgtcaagtgactttgaaggcagtacgatgagagaactcttccgtttggctgacaaaaacatgtatattgataaaaaccgtgcaaagatggaggaagcagcagagaaacagaggatgaatattcgtcttctggaagaaattacagaaaaggggtttcagtttacggactgcatttattgcgatgcgcttttggatcagtattatgtactgcgcgcaagctcacgatttttcctggccgaggatggaagctattccggagctgttgagcagatcgtgcaggaactgggaacggatgagaatcgcaagagtatgagaaagaaattgcagatttcttatcttgcagaacagatcaaggacaaaggcgagaagctggagcttccatatcagtacaggaaagaggacagtatttgtcgaggacgaatgacagcactgtttgtaaataataccgaagatggcaggcttcatcatttcattctgggatttgaaccattccagaataaaaatgaaaacacagcagatgaaaggactcgactgaatcgatattatgaacagctgaaacagtccattgttgaaaatgagaattatgcggaggcactccttcagactgcaaatgcagtctatactgtggatctgacgaatgataagctggagaatgtttattatcatgaggcagcatttaaggttgaaaatgatatacagacaccatgttcttatagcgattattgcaataaacggagtcggtatgtgaccgaagatactttggagaactacagaatcgttgattcttctttcaaactactgaagcgatttgctacaggtgcgaagcaggttacagtagaatactgcgaaacgatgggaaaagaaaataagccggtatggctgcagaaaacagttctgatgtccagagatatggtgtatgatgcgaatacagataaagagagttccgtagtccatggaattgttctgtttaagaatacttcagatttccatgaaaaggaacagcaggaaaaagcgcgtttgcagatggcttatgaagaagcggattctgaaaacagagccaagacggaatttatgaatcgcatgagtcatgatattcgtacgccgatcaatggaatcatgggaatggtagatatcatccgtaaaaacagggatgaccgggaaaaagttgatgacagtctggataagattcagctgtctacccgacatttgctggagctagtcagtgatgtcctcgatatgagcaaactggaagctggtatgtttgagattcatgaagatgtatttgatatgaatgagcttatggatgaagttgctgcacttgtggatgctcagctggttgaatccggtattacacattgcaagcacagaagtaatattcagcatactgccttgaagggaagctccctgcagctgcggcgtatcatggtcaatcttctgagcaatgcaatcaaatataataaatcaaatggaacaattgatacatatgcggaagaactttcctgtgacggtacaaccgtgtggtatgaatttaaaatcgttgataccggaatcggtatgagtgaagaatttataaaagaacagctgtttaaaccttttacacaggaaaagaatgacgccagaacactgtacagaggaaccggtctgggaatgtcgatcgtcaaggcgcttctggataaaatgggaggttctatagaagtagagagtcaacttggagagggaagtacttttactttccgccttccgtttaaagttgatgaaaatgccatcgaaaccaaaaaagaagagcagagctcaggcgaacagaagctggaaggaaagcagattcttctggttgaggataatgagatcaacatggagattgcagagttctatctgaaggaactgggaattgtggttgataaggcatggaatggcaaggaagcgattgacaagtttgaagagtcagcaccgggaacttatgatctgattctgatggatattatgatgccggttatgggcggcagagaagcagcccgtcgtatacggacactggagcgaccggatgcagaaacggtgcgtatatatgccatgacggcgcaggtttcttccgaaagtgtacataaatgcctggcttccggaatgaatggacacattgcgaagccgattgatgaaagcaaactcagagaaatcctgaccagatgtgaaagcgtgaaaaagcagaaggattaacataaaatagagatacgataaagcaagatcaaaagttccagtgaatttttgttatcgctaatcaattatgtgctggagacagcccgaattgagagtggaaattcactgaaatatactccggcaggtggtaagatcaccatagatatcagggagattccgtttgacagggaaaattatattgcatataagattgtagttgaagatactggaattgggatgagtgaagactatcttccacatatttttgaagaattttccagagaacatacaagtacggaaagcaaagtagtcggaacaggtttggggattccagagctgctgttccgatcgtagccatgacagcgaatgcttttgaagaggacaggcagaagacacttgatgcaggcatgaatgcacatgtatcaaagccggtggatatgaatgttctgttccgagtgatggcgaagttcatctgatttcgctgtcgttataatatatggaagaagcacagtaaatagctgcatgaggaggagctgtccatgatacagcagaaaaagattaatgttgaaagaattcttcgcgtcaacagagtaggagcatggagaatagaaattgaggatgggaaatcaccgagattttatgcagatgcggtgatggatgaattacttggaatccagggagaaatctcaccggaagagcgatttacatttcatcgggcacgtgtacatccggatgatatgcagttatttctggaatattcagataaactgtcagagacaaaatcagaaatcgtatatcgctatattcatcctacatttggagagatgttcgtacgttgcagtggcataagagataggtctgtagtggatggtatttccattatgggaatacatcaggacatttcagagacggtacgtttggagaaagaaaaagaagcggaacgtcgtctggcggaacttaatgatacacttcgtaaagaaaagatagaacaggaagattattacaaagaactgctggaaatgcaaagttgtggtgtccttgcatatacaattcccgggcataagatcattcatatgaatgcacaggctttgcggatgtatggagtggagaacattgaagaggcacagtccaaactcggtactatgctgaaaaaagtaatctatccggatgtggacgtaatagagaagttgaaaagacttcacaaagtagatgatatggttgattatgagtgtatcatcggaaaaggtgagccgaatgaatgtcatgcacttgctacaacgaaagtaatccgtgttccatcgggagaaagagccgtgatcaccacatttcttgatgtatcagagatggtagtacttaagaatgcactgcagaaggcggaagagggaaacagggcaaaatcatcctttttatttgccatgtcacacgatctgcggactccgatgaatgcaattataggatatgcagaactcatggagcggcactggggagacaatgagcttacgacaaattatctgcataagttgaagggagcgagccagttcctgcttgcattgataggaaatgtactggaaattgcccgtattgaaagtggtaaggaaactttgaatgaagcaccatggaatctgaagaaaataaatgatacgttggagatcgttcttgacagagaaattctgaataaacagctacatgtagcacgaaatatagaaattcagcatgcagatgtatattgtgattcgctgaagattcaggagattatcatgaatcttgtaagtaatgcaattaaatatacaccggatggaggaaaaatagacgtagatatcgaggaaatggaggctgtcggagaggattccataattctgcggatttgtgtttcggatacgggaattggtatcagccagaaatatattccacatatatttgaggcatttacacgcgagaaaaattcttcggaaagtggtataatgggaactggtctaggactgcgtatcgtaaaatcctttgtagatttgatggatggaagcgtgatcgtacaaagtgaacctggaaaaggcagcagttttattgttgagattccatgtcggatcgtatcggaagaagaacgtattgaccaggcagaacagagcatgccagagaactttctgaagtgcaaaagaattcttcttgtagaagataatgaattaaatgtggaaattgcaaggacaattcttcaggatgtacaggcagaagtggaagtagctgcagatggcgcgattgcagttgcaatgctgcaaaaggctcctgtcgggtattatgatgtgatattaatggacatacagatgccgaagatgaatgggtatcaggcaacagaggcgattcgaaagcttccggatgaaagagctcaggttccgatcatagcgatgaccgcaaatgcatttgaagaagacagacaggcggcgtttgcagcaggaatggatgattatctggctaaaccgattgaaattgataaattacttcgcaaaatagtaaaggtattagaaaagaagtaaaagacgtcagatagggaaattgcaattcagacggagaaagagatattatggagatcaaaattcggacagcgaaagtagaagatgcagagaaattgctcgacatttacagctactatgtgaaaaagacagcggtgacatttgaatatgaagttccatcggtcgaagagtttcaggaacgaatccggcatatttcttctcattatccatatcttatcgcagaggaagagggagaaattattggctattcttatgcagaccgtctgcgtccgagggcagcttttggatgggatgtggagatgacaatttatctgaaacaggatatacgacgaaatggtttaggacgacatatgtatactcttatggaagacatcctgagagagcagggcgttgtaaatgctgtttcattgattacaaagccgacagatgaatattctgattttaatagtgtacagtttcatgaaaaaatgggatataagcatgctggtgagctgaaagactgtggctataaattcaatagatggtatgcacttttgtatatggataaacagattggaattccacaggaagagatgccgccaatcagagattttgacgaagtgcgggaaaaatttggcctgtagatttttcacgaggagaaagtttattatgtgctataaaaacggaggtttgaatgatttacaagaaagttgagattaaagtagaaggttatcaggaaactgcggatttgtatacttatattctggacaattctgtggaaatgcgtccgaatcgaaagcgcccggtcattgtgatctgcccgggtggcggttatacaatgacctctgacagggaggcagaaccaattgccatgcagtatcttgcaagaggataccatgcagtgatccttcgttacagtgtagccccggcgagatatccactggcacttctgcagcttgcgaagtctgtcgcatatttaagagaacatgcagaagaatttcatattgatactgctaaaattatcctgcagggattttcggcgggtgcccatctggctgcaagtcttggggtattctggaaggaaaaatttatctccgaagtattgcatacagaaacagaaatagtgagaccgaacggcatgatcctcagttatccggtcatttcctccgggaaatttgcacatacggggtcttttgaggcattgcttggagctgacagcagtgatcctgaaaaaagaaaaaagcagtcgctggaatttcaggtaacaacggatactccgccgacttttctctggcatacggtcacggatgattgtgtcccggttgagaattccctgttattttttgaggcattgcataaatacaaagtgccggtagaactacatttgtacccgacaggtgttcacgggctcagtcttgcaaatgaagagacatgtcatgaagatggtggatgtattcagccggaatgccagtcatggatggaacttgcgtgtacatggatcaggaatttataaaaaaagaaaaaggtgttccataaatcggaagacctttttctttttgtgaaattttttgtaacgtttcccatacatatatcgtcatatatgtgaaggaggacaaaactggtagagagaggagaaacaaatgctgaatattcaggaagtatatgagcagtattttactgtcgtataccgttatctgctctcgctttcgcacaatacccatattgcagaggaactgacgcaggaaacattcttcaaagcactgaaaaaagtcgacgatttcagaggtgactgtgacctgcgtgtatggctttgccagatttccaaaaacacgtactatgactatctgaagaaaaacaagaagtatgcaccggaatctcaggacgaaaagaaagaaagctttccctcagatctgcttcagaatttttcagataaagaaactgcacttcaggttcataaggttcttcacagactttcagaaccctataaagaagttttttcacttcgtgtatttggagaactgtcatttggtacaatttcctcgctgtttggcaaaagcgaaagctgggcaagagttacttatcacagagcatgtaaaaaaatcagggaggaattggatcatgaagatcagttgtaatattattgaggacctgcttccgctttatgtggacgatatggtcagtgaggacagcagacagcttgtggaagagcatttgaaagcgtgtccgacatgccgaagaatgcaggaagaaataatgagggaaaatcatctgacagatgttaaaaaaggcagtgattctgtacagacaaataaaatggaagcagaactgctcaaaaaaattcgctgtaagattcgtaaaaagagaattgcgtcggtactcctggcagttgccattgttctggcagccggtggaatcgggcattattggtattatgataaggaaaattacatttcctgggacgaggcaaacatatctgtaaaggatggaaaagtatattctacggtaaatccattgggaaggatgaaatcaattctgtccgtagaccaaaaaaacatgttttacatgctgtcagaaactatgtggacccacaaagaatatccatccgattcaaacacagaaaatgaactctggaatctgcaggattttcaggaagcatatgaacgtggagcagatacagttactgatgaaacatcttttccaacaggaattgaacatgtttattatgtagatccggaaaatgtaaaagaggcttttaaactctgggattatcaggatgaacctgagaaggcgcagcagaaagaagaagagctggccgcgaaatgccacctgatctggagcgcatattaaagtggattatcatgagtattcttctgacagtggcggcagaattcttaagcagcccatgctatcatagttcttttgtaatctaatcatagaatccggtacagctttgtggtaagatagaacaaaaagcaagaaaggactgcaccagaatgggaaattatctgaatccggataacagcaaatttcagagagcggtaaattctgatatttatgtggataaaacaggactgataaaatatacgaatcgtgtaataaataccatgcaggcatatgtctgtgtcagcagaccgagacgtttcggaaaatctatggcggcagatatgctgactgcgtattacagcagagggtgcgattccagagaattgtttgcaggcctggaaattgcgaaagatgagaattttggcggatacctgaataaatatgatacggtttttctcaatgtacaggaatttttgagcagaagttctgatgtgaaggaattaattgcgagaattaagcaaagagtaattcgtgagctgacaaggcaatatccggatgtagagctatttgattcgacagatctggcagaaactatgcaggatatctacacagaaagtaaatgtccgtttgtgcttatcatagatgagtgggactgtattttcagagaattcaagaatgataaggaagcacaggaaaaatatctggattttctgagggatcttatcaaagacaagagctatattcatctggcatatatgacaggaattcttcctatcaaaaaatatggtacgcacagtgctttgaatatgtttgatgaattttccatgatcgatccgggaccgctggcttcttatgtaggctttacggaaagcgaagtagaaaaactctgcggagaataccagatggatatagacgagataagaaactggtatgatggatattcttttgaagaagttccgtctgtatacagcccaaagtctgttatcagttgtatgaggcttggcaggttgggaaattactggaaccagacagaaacatttgaagcactgcagctttatatcgatatgaatttcgagggtctgagggacgatatcttaagtatgctcgcaggagaggaagttccagtaaatacaggaagttttacgaatgatatggcaaccttccgtacagaagatgatgtcctgacactgctgattcatttgggatatctggggtatcgttatgcgacaaagacagtatttattccaaatggagaaattcgtgcagaatttgtgaatgcagtttcagtatcagattggggagaagtatccaatgcccttaagaactcagcggatacgctacaggcaatctggcagggtcgggaaaaacaggttgcagagggaattcgacaggcgcattttgagacttcacatattcagtataatgatgaaaatgcattgagttatacgatttctctggcactttatgcggcaagaaatttttatacgtttcatagagaattatctggtggaaaaggatttgcagatctggtatttattccgagaaaacgttttatggataagccggcattggtggtggaactgaaatgggacaaagatgcagcaggtgcaattactcagatcagagagaaagaatattgcagaagtctggaagaatatcatggaaaacttttgctggttggaattaattatgacaaaaagacaaaagaacacagctgtaagatagaggaatacaggaaataaattgtatgaaaaatattattgaaatcaacgacattactgcactggaactggatgtttatgcgagaacatccgaggtgcagcttcttagatataatgagccaaatccaggactttttattgcagagagcccaaaggtgatcgagcgtgcattgaaagcggggtacgaaccgctttcttttctggttgaacataaagatctggatggagaggcaggagatatccttgcgcgttatccggaaatcccggtatacacagcagaatatgaaacacttgtcaaaatgaccggttatgcactggcaagagggatgctctgcgccatgaaacgccgaacactgccttctgtagaagaaatctgtaagaactccagacgtgttgctatactggaaaatattgtgaatccgaccaacataggggcgattttccgcagtgcggcagcacttcatatggacgctgttcttttgacaggaggatgcagcaatccactctatcgaagagcggcccgcgtaagcatggggacagttttccagattccatggacttattttgacaaaaaagcttcctggccggaagatggtatgaaagcaatccagaatcttggattcaaaaccgtggcaatggcacttagagaagattcttatagtattgatgatccgaagcttcttgctgaagagaagcttgcagtcattcttggcaccgagggagacggactggcatcacagacgattgcggactgcgattatacggttaagattcccatggctcatggtgtggattctcttaatgtggcagctgcaagtgctgtggcattctgggaactgggtaggaaacgatagttgagaacggaatgaacagtaacaaattcattgacgatacaaaagcgaaacagattatgacaattaaggtacagctgtgatcacagtaaaatccggaagcaagacagttaaatgcaaagtaactgttaaataaaatctaaattaaaaagtgagtaaaaagttctccaggagacattgtcttttggggaactttttactataatgcaaaggatagttatcagaaggagaagagtcaaaaaatgctaaaaagattttcaaaatacatatgccagagtgtagctgccatgatcgggcagtccgtctatattcttgcggatactttttttatatcatttaattcaggagcgaacggtctggcggctcttaatctgatcctgccggtgtttggaatcatgttcgcgataggctcgatgatcggaataggatctgcaacaagatatgggatcagcaaagccaagggtgaagatgcagatcattacttcacacagtcaataagctggagtctggtgtgcagtgttccatttatactgatcggtattttgaccccggataaatttctggcgcttcttggagcagatgcaggtctggttgagctgggaaaaacttatctgcggatcgttctcatctttgcaccattttttatgtgtaattattcggtaactgcctttgcaagaaatgataatgcaacttcaacggtaatggcaggttcactgactggaagtgcttttaatattgtgtttgactatatttttatgttccctatgggacttggattttccggtgcagcacttgcaaccgctttttgtccggtagtgactatgctggtatgttctactcattatctgagcaaaaaatgcaatattggtttcaaatggaaaagattgtctctcagacatctgatttcctgctgtcagcttggtgtgtcagcatttgtaggcgaaatttcttctgcagtgatcacgttcatattcaatatgctgattctcggacttaccggaagtaccggagttgctgcttacggtgttgtagcaaatatgtcacttgtagggatggcaatcatgaacggtatgtcacagggggcgcagccgctgatcagtgaaagctttggtaaaggtgcagctgatgatgtaaaaaaacttctcagctgggctttgaagagcgtagtggcagtagaaatcattctggttgctctggtctggatatttaccgatcctttcatagctgtttttaacagcgaaaataacaggctgcttctggaatatgcacatacaggtcttcggttatatttcctgggatttttgtttgcaggagtgaatatcatgcttgttgcatatttttctgcaacggcaaatgcgcgtccggcaatcattggttcattgctgcgaggtgcagttgctattggagcatgtgcgattgtactttccatgatttggggaatgaatggcgtgtggctgtctttcctgacatcagaaattatcacctttgcggttcttctgattcttggaagaaataaggaaagcaggaaaatgaatgaatacgtttgatattatacttcagcaggttggattattcgttatttacattctggcaggcctgcttctggtcaaaacaaaagtgctgaacagggaaactttggaaccgatttcaaaatttgtgatcaaaatggcattgccgctgatggtttttattaatatcacagatggaacagacaagaagaacctgtatgagtcgtggccgattcttgtgattgcggtcggtttttatatctgtatatatgcagcaggagcaatggcagtgaagttttttaaacagcaggaaagtcgtgtcggaatctatcgggcgatgctgctgttcggaaatatcgggtttataggacttccaatgatctcaagtgtttttccggaaaatggaattttgtatgcttcagtatttatgcttatagaccagtttatgctgtggactctaggtgtgaagctgacatctccgacgggtgaaggaggcttcaagctgaaaaaaatgatcaaccctgcaacagtggcaattgtgctcgcaatagtactgaagtttacggggataaggattccgattcttctggatactgccttttcaaaaataggatctaccgcatctccacttgcaatgatttatgtaggaggaatttttgcaggaatttcattaaaaaaatatctcagggaaatttctctgtatggaattgtattgcttaaaatgattcttgcaccggtctttttgtttttgattctcggactgtttccggtttcaggtgagctgcgtcttgcaacgtcattgatcgttgggatgccgactatgacggcggttgtcatgatggcgaatgcgtccgggcttgacggagattatgctctgggtggtgtatttataacaacgatcagtggaattattacacttccggcagtatgttggcttctgcaatatgtattataaatatgaaagaagggtatcaattttcagaggaaagttggtatcctttttgatttatcttttcaataaggaaacatgaaaatccttgcatgatagccagaattagtctatgctaactacagagttagataaaagaaactcttgtgtaaataaaacagtcgtggtctggtacagagaccggaggccgggctgaaaagtagtagaaaggggatttatcatgtaccttgagattgagaaagttgtaggaagagaaattctggattccagaggaaatccgacagtagaggcagaggtttatcttctggatggcactgttggcagaggaactgcaccgagtggagcatccacaggtgagtttgaagccctggaactcagagatggagataaagcacgctatcttggaaaaggtgtacagaaagcagtcgaaaatatcaatacggtaattaatgaagcaattgaaggtctggatgcaagcgatatttatgcagtagatgcggccatgattgcagcagacgggacaaaggataaatcaaagctgggtgcaaatgcaattcttgctgtatcgatcgcatgctgcagagcggcagcaactgcattggagattccgctttatcgttttcttggaggtgtatctggaaatcgtttgccagtaccgatgatgaatattgtaaacggtgggtgccatgcactttcatctggactggatgttcaggaatttatgatcatgccggttggagcaccttcttttaaagaatgtttaagatggtgcgcagaagtgttccatgcgttggcttctattttgaaagaacgcggacttgcaacatccgtaggagatgaaggtggatttgctccggcgctgaaatcagatgaagaggcaattgagacgattctggaagccgtgaagaaagctggatatgaaccaggaaaagattttaagatcgcaatggatgcagcttcttctgaatggaagagtgaaaagggaaaaggatattataaactgccaaaagcaggtacagaatatacagcagaagaacttattgaacactgggctaaactctgcgagaaatatccgattatttccatcgaggacggtttggacgaagaagactgggaaggatggcagaaacttactgcaagactgggagataaagtacagcttgttggcgacgacctgttcgtaacaaatacggaaagacttgccaaaggtattgagcttggagcaggaaatgcgattctgatcaagctgaaccagattggttctgtttctgagacattggaagccattaagatggcacataaagcaggatacacagcgatttcttcacatcgttccggtgagacagcagatacaacaattgcagatcttgcagttgcgctgaatacttgccagattaaaactggtgcaccgagccgttctgagcgtgttgcaaaatacaatcagcttctccgtatcgaagaagaacttggagcgagtgccgtatacccgggcatgaaagcatttaatgtaaaacaggattaaaaaaaattaccttctaaagcagaacagatccccggcagcaagacagggatctgtttttatctctatatcacatgggagagtcctttttgcagggcaaggatcttattataaattgcatcagccagtgcggcatgacctttttcatccatatgttcacggtcagtaacacttggagcagcaaaatcagatgcgtttaagaaggcagcatgattttggagtgcaatcttgcggtattcattagccagatttctggaaaccgctacagaagctgcatcaaattccggatcaaaatcggcatctccgacgccaacgcccaggtggattggcgagatgacaagcagatcaaaatgccgggacgcattctgacgtgcttttcggattacctgatcaagtccttttgcgatcacactggcggatgctttgtagcgtgtcttacagtcattcgtgccgagcatgatgatcatgaggtcaattgggttatgcatctctactgtgactccaatcagatccagtccgcggcggccctcacgcagctcatcctgaaagacagttgttctgccgcaaagtccctcttctataatgtgatatccagatccgagttttttctgtaaaagtccggtccatcttatattttcatcataacgtccggatttatccggcttatatccccaggtattcgaatcaccaaagcataagatattcataagaccacgctccttaatcaaacaaaatcatacaaacataccaaataaatatgttaatataataaaggtatttcattgaattgtcaatgataattttcagaaatgaaaagatggtcattttgtttttttggggagatagaattcacgaaatggttaattaaatattgcagatcaggaaaaaagagaatataatggatataagttaaatagaactaacttaaaccatgaaaaaactatttcatggatatagcatatactgtaaacagaagggcatttagattggggtgtctgaatgacaatcataaaatgcgcaagggaggagaagaatgaatttaaacgtattttatggaattttgattccgtttatcggcacatcagccggtgcggcctgtgtcttttttatgaaaaaagacctgaaccagtgggtacagcgctgtctgaccgggtttgctgcgggtgtcatggtagcagcatctgtgtggagcctgctgatccctgcacttgaacagtcagaaggaatgggaaagctctcttttgtaccggcagcagttggcttctgggcaggggtgctattcctgcttttgttggatcatattattccacacctgcatcaacaaacagataaggcggaaggaccgaagagtcgtctgcaaaaaacgactatgcttatattggcagttacacttcataatatcccggaaggaatggcagtcggtgtcgtttatgctggttatctgaccggaaacgtgcagattacgttgatgggggcacttgcactgtcacttggaattgcaattcagaattttccggagggggcgattatttccatgcctctgcgttctgagggaatgggaaaaacaaaggcattcattggtggtgttttatcaggaatcgtggaaccgatcggggcagtgatcacaatcctggcagcaggactgatcgtcccggcattgccatatcttctgagttttgcggcgggagccatgctctatgttgttgtggaggaactgatccctgagatgtctgccggggaacattcgaatattggaacgattttctttgcagttggatttacgctgatgatgatattagatgtggcattaggataagaataaaaagggcaatacaaagtgcataggaaaagatagtgtgcaaattatacaaaaaacagtaaataaaattgtgaaatatgtttaaatataaagttgctattttgcctgaaaagtagtaaaacattagataaataaaaaagagaaatgcatcgaacaggacaggtcacaaaaggaaaccggattacagagagccgctgatggtgagaagtggcagaaagtattttgtgatatcacccgggagcatcccactgaattttgagtaagctgggacgtagtcttcacgttacagaagagactgtttacagagacagtaacaagagatcatatttagtaatagatatggtaatacaaagtggtaccacggaacattccgcctttgttatccgaatggataacaaaggcgtttttttatataaaccataccaaaagaaaaggggaaagattatgagtggaattttaatgatggtaatagccatagtagtgcttggtggagcatatcttctgtatggccgttatctccagaacaaatggggaattgacccaaaagcaaaaacaccggcatatgaaatggaagatggagtggattatgtaccggcagataccaatgtagtatttggtcatcagtttgcatcaatcgcaggtgcgggcccgatcaacggaccgattcaggctgcaatttttggatggcttccggtaatgctctggattctgatcggtggtgtctttttcggagccgtacaggattttgcttccatgtatgcatctgtaaagaacaaaggacgtacaatcggatatatcattgaagaatatattggtaaattaggaaagaaattatttcttctgttttgctggctgttctgtatcctggtcgtcgcagcatttgcagatgttgtggcaggaacctttaatggatttgcgacaagcgatgcaggagtcgttacaaaagtagccgcaaacggcgcggttgcaactacttccatgttattcatattagaagcagttgtacttggatttttccttaaatatacaaagtttaataaatggatcaatacagctgttgcaatcgtattattagtagcagcaattgtactgggactgaatttcccaatgtacgtaagccttggaacatggcatatcattatatttgcatatattctggttgccagtgttgctccggtatgggctttgcttcagccgcgtgattacctgaacagttatctgctgatatttatgattgtcggcgctgttattggtgtatttgtagcaaatccatcctgtaatcttaaagcatttacaagctttaatgtagacggacagtatatgttcccgatcttatttgtaacaatcgcctgtggtgcggtttctggtttccattctctggtatcttccggtacggcatccaaacagatcaaaaatgaaaagaatatgctgccggtttccttcggcgcaatgcttatggaaagtatgcttgcgatcatcgcactgattgcagttgcatcttttgcagatggtgaagctgctgcacagggactgactactcagccgcagatctttgcaggagcaatcgcaaacttcctttcagtagttggtctgccacattcattggtatttacactgatcaaccttgctgtatccgcattcgcactgacatcccttgactctgtggccagagtaggacgcctttccttccaggagtttttccttgattctgatacagatgaggaaaatatgagtccgttcctgaaagtagtaacgaataaatattttgcaaccgtcatcacactggtacttgcctatatgcttaccaaagtcggatatgctgagatttggccactgtttggttctgcaaaccagctgttatccgtacttgcacttgttgcgtgtgctgtattcttaaagaagaccaaacgtcagggctgcatgctctggatcccgatggtatttatgatggcagttacctttacagcacttggaatgacgatcacaaaactttcaaaagcactgctctcaacaggccttgatcttggaaatacattacagcttgtattcgcagtattacttctgatccttggtgtgctggtagcaattcagggcgttaagaaacttcttgaaaaacaggaagcataatataaaaataaacaaagagcagcataccggcgtaaaatgcgggtgtgctgctcttttactgtgaactgaagtttatgaattataaatcaacagcagtatgaggatttaccactcctctgtagactgcccagccaagcaccagaacagggagaaaaacggatgcggtagaagattttttgaatgtttgctgacatagttccatatatgtgattttttcttagttctggcagactaattgattttgttgcaaaaaagaaaagcaattggcataaaatagaatagacagatatctgaaaagagagtatttatgccggatcagaaacttgataatcttttaaaccttgcaatggatgctacgtcacaggagcgggcgaagtcggaaaatctgaatgtgggatatgatcctacgaccaggctgtgggatgtgatcgtaaaatacagtgaatcggaaagaggacttggtggtgatggaattcaggtagttccgctgcttggcggttatgctgtggttactttaccggaaacggagcttgatgcatactctgacagagagcaggtggaatttatagaaaagccgaaaagactttattttgagacttttgaagggagagaggcgagctgtatcctgccagtacaggctgagttaaatgggctgaccggtgaggggattctggtcggtattgttgattccggagtggactattttcatccggattttcggaatgaggacggcagcagtcggattctgcgattatgggatcagagtgtgaatggaaatccaccagaaagttatgtgacaggaacagaatatacaaaagaagaaatagataaggcgcttgcacttgaagaaactgagggcaggcgccttgttccgtccagggatttcagtggacatggtactgcagttcttggaattgcagcgggaaatgggagagcatcaggtggagtgaaccgtggtgttgcgtatgaaagtgaacttctggttgtaaagatgggaaatgcacgagaaaattcttttccaaggacaacggaactgatggaaggaatcgattatcttgtccgacaggcagcgcagatggggaagccgattgctatcaatatcagttttggaaataactatggttcccatgaaccttataattaagggaaaacataagaaaacactgatatttcctgtgttttcaggcaattcagtgttttactcggattcatgtttggttgttgtttgagtcttataatactcggtcaggatcatgttaatctgctgggaacgtgtacgatagttcgcttttgcatccttatcaatctcagcaaccagttctttggacaaagtagtatagacctgaatattgttggaactgatagccatgtggcacctccgattcaatttaatagaattattctatcatacttcttcgggaggggcaatgtgaactgaaaattgaagaattattgttactgtaaaattggaacggtcgtaaagaaaatctatgaatagagaacgataagaaaggtagaacagacaatgaagaaaacaatttttgaagagatgggcggtacttatatcagacatggggattatcttatccctgctcttaccttaccgaaggaagaagaacaaagggttgtcggtgtatggggacaaagacatttgcggtatttgaaggaataccgcagattgctatatctgaatatgcttacaagcggcaggctgaatggttatttggctgatatagaagaacaggcacaggaacgctttgaaagacttgtagaacagatgaaacaggcacaaggcattacagaacagctaaaggtggaaaatgtcttggaatggataggaagaatgaacaatatacaagtatgtgcgagggagattgtggataaagagataatttatcaagaatgaaatgtaagataaatagtgtataaaatgtagcagggcatcataagataaaattgtaattgcattttccacatagttcgtgtaaaatgtaattagaaaagctgtgcatcagcggtgggttgacacctaaaatctgatacgttttccgaacgaaggtgtcggaggttggcaggcaacggaaaaacctgatattttccagacgaaggtgctggaggttggcagacaacggaaaaatcaaccatgagaagggaatgtttagtgctgcggcgtgaacattcccttctctaaattttatgggataaggattaagttatggacaaaagacgtgcaattcagattatgacaaaagcggcacaactatataaagaacatcttgaggatcagaaggttttgttcctatatggcttaccgaaagaggtgaataagcaattacaggaaagtaataagattttgtcatctgtacagggatatgaagttgttttccatagatacaattttttacatttgacaggagttcgattgaataaaaaagagacagcttctgcaattcatttttaccagaaatgcctggataagcgattaacagaaaatgattttgtttttgcaaaagatggctctacggggcaaaaattggatatattggaacgtatgatgcttattaagaaaaacgtaacaatgataggagaatttacagatcgaggaccgaaattatatacagaaaaagctgccgggaatatatgtggttgtattggcttcgtaaaagataaaaatacgaaattaaatgtaccgaacacattgctgaaaaaggacatcagagatgtaacagcacagcctacatataaagtatttgctgtaatatcaaaacactatacagatgagaaatatacaaatcttgtgaagatggacaaaagtattgatttgaaagagtgttgtttctcagaaacaatagaaaatatgatagatagagaaaatctataatgaaatataaagaaaccatgctactgctttttgtaacagtatcatggttttattgtttgtcgtctatattttaagttgattattactttacaaaattggcaatgttataattatcattgattttagaagaagggagtatcgagggaaattagtggaactggttttgcaagcatagcgtttggatatccaaacgcactttgggagccccccaaaccccatttgttggctttacaaagtaggaattttttgctcaagataaaaagagagtgcgtaagcggaaagaaatcaaattatgcttacgcactttgtgcctcacttttgctcggtggttagcagtttgtgaattattgggatgaagcaatataactgttttgagaaaacgggatattttttatattagtagtttaaacattatagttctgtgttgtgcgatttttgcctggattgaacaggatgttttttttgcaattcctgtttcctctgatattcaagttcccaggtacgatgagagaagctatagggatcttccatattgagatcatccacttcatgggttgcgatatcacgatagtgatagtcataatattcaccaaaagtacctttgagctgctcaatcagtttctctcggaaagtaggtcgtatctggattctggcatccagtaattctgtatattgctctggtttaggccggagtttttcctcttggaaagcgacagcatctttttcaagctgctctttgagagccatatcctgagaatcgagaatatccagattcttatccatctggtcgtattttctggaaaggctcgccatatctttctctgtggagcattcagcctgaaacagcagctgttctttggcagatttcagttcctcgatttcttctgttacggttgtaagctgctggtttaactttatatgctggaaaggatttagaatactggttttacttttttgcacatttagttctttcttttcagtaactttcgctttgagctttttcttaatggtatcatatttatttaggataggacgaaaatgctgcatccagtcatggatcacttctttttgcatttcattatgaagtaaatgatattgtgtaaaaatcatatgattgcggattgcttctaatgtttctgcaattaccggaatagatttttcgacagcttgaaccaatttttttatctgtgtttttaattcccgtagtattctgttatccgcacgaacccgacggttgatttcacaccggtctgctatcatgcctttcttttccatattctgggcaatgtagccttcgtggatggttggctgttcagtgattccctgagctgcaaaactgcggtgatcaatggcggcatttatctgattaagggcaagcattttatttacggcatctgcccagtttgctctccagaggcagagctgttcctcactgttccattgttcggaaatcgggttttgtctgccataccgggtgctttttggatgtttgtcgatacgttcataacctttctcctgtgctgccgagggagtcagatatactttctttttcccagctttataacgatactgtttttcccagccctctttctgagcatccttaaattcagaagcagtaaatcccttttcctctccatctttgatgcatagatattctttttcggttttatactgccatgttccgttttcgtttaatggacggacagtaagtagaatgtgtgcatggggattgtgaccatctgtatcgtgaatggcgaaatcggcacacattcccatatctacaaaattcttttgaataaaattctgaagaagagaaatattgctgtctttatccaactcaatagggagtgcgacaacaaattctcttgccagtcggctgtcttttgttttttcagcagcttctacagcattccagagttgctcccggtttttccatttaggcggagccatagggggaagcattacttcctgatagatcagtccatgttttcgggtgtagtcatgctggatgccatcgtaatcattgtatatgcggctacagctcatataagcagatgcagcgacagcagaccgcccggaaccacggctgacgaccttggcttgcatatgataaattgccatatctggcacctcctttcgatgttgcctgcaacagcggatagccctcggcagagcgcacgagccccgtaggggataccaccgcccgatttatcgggtggtgagtaagtgcgcccttcgggagtagaacttgtgtatttacattcctcttagccggagcatcagctcccgctttagggtatctaaatccatttctttaatatgtggagcaatgctttccagaatcgctccttcttgaatcaatctgcgtgttctggcattacgttcctttttacggtttcttgcttcgatttcttccagtctgtgttttgcctgtaaaagcactttttcttctggtgtcataattcttttatttgccatatctggcacctcctttttatgcccgtatccgggcgatttagttttaaaatcttgtggtttagtactatagttttagataactgacagtggcatgtctctggtgataaataagaaaagaaagtagtactactgtcagtgaaaaatagttattgtgcgatgctgctttgtttcaactctggtttgaagtgtgattatctaacagaatttttttcgttttttttaaattagctgttgcattgtcctgacggatattccggttattgatacggatgggaacacatctctccagaatccggtcataaattcgcttgtgtgcgatatcagcggcgttattcagctctgataaagtgagattggttgttatgatcaggggctttttactgcggtaacggctgtcaatcacattgaatacctgttccagtgcaaagtcagagttccgttcaattccgaggtcatcaatgatcagaaggctgtagcggtttaagctgtggatgaactgattcctgtcttcaaaatgcattccggtaagggtattcagaatccgggaaaagttggtcatcagtaccgggacgcctttttccagaagggcattggcaatgcagcctgcaaagaaagattttccagtaccgacatcgccccagatgagaagtccggaagcgtttgctttcatctcttcccagttacttacataattgtgtgcaagtttcatttccggattgctgccgttatctttggcaaaggtgtagtcataaagtgatttgtcctgtaagccgctggttttgagatgctctatttccatttgcttttcatgaagttttctctgggcttcctcctgttcaaagatctcctgctggcacttacagcggatggaaggaataagaacctttccctgtaattcatgcctgcactgtcttggcgtattgcatttggaacagtagatcaggtgatttgtttcgttaaaatattcatcagactgaagctctctgtttggtgtgatagctgttggtttttctgtaaatgttgtcataatgtttcgtattcctcactttcataatttcgttgccgggaaacaggatgatcctgtcttgcccaacggatgatggtagctgcatggttttggtattgctttccggtagaagccatataaccggataagcgttccatatagtcctgccagtcagggattgtctgccggatattttccagctccgtctctgacagaaaaacattttgaaatgttccatagggtgagcgtggctctttactccctcttattgttaaatggttcttttttatctctttcttattactggacagttttctgtctgtatcagggaaagaatcctgtctgtcaataggacagttttctgtctgtcttgaggaaagaattctgtctgtattgctgagggtttctttcgggatttttacatagatccgattagggtgtccgggtccctgccgttttcggaagataagctcttgtttttccagtactgccagagcagttttcaccgtcatctggcttttgtggagaacttctgccagtgcttcaatcgtaaagtagaggaacacatgaccatttgtatctgaccagccctcatttttctgggaaagccttgcacggtcgagcaggatcatataaagcattttggcagtttcgtttatttccatgtccagaagaaaacggggaaacatcatataagatggcaggcttgtgtctgctgtcagaaagtccgtcatgtgttcacctccaatcacaatggtttattctccaagaaaatcccagtctatatcacgatccggctgttctttttcaggagctggaaagggcatcctgatgggggattccctttccaacatgcctgcagtcagcccggacagaaaaatcggcaatgactgtttcaggctgtgttctactgcttctacaatctgtttcacaaaaagttcttcccgttcccttgtttccagatagggatcagcctgagtgcggtagtagcggtcaaaataatcgaccagtgcaagggagattacctggctgtaagatttaaaattctgtctgtccatcgtctgtaaatattcccaggctctccgctgctggtctttgtccagattaaatcgcaggtttgtgttgcggatatggttctgcatggcttatcccctccttttcaggctcatataagccagagattcataacctttggcagtggcacagatatcatcaaggatggtaactcgtgatttgtcatacgctccaaagttacggatcaggcatccaccgcctccgaccacatacaggcgcatcaggccaggattgtattcatatttgcggagcgtggcaaaaatatctgtgacatactgtctggcaacagcagtaatacaatccagataagacgctgaaatgtcagcggttccaaaccgcagaatctgctctacggtagattcttcaatctttactccgaagttgtccagaacagcgtttttagcggcaatcatgcattggtttacgccaaacttttctgtccagcaccggctttcctgtgctttcttattattgatatacagaatgttcatggttccgttgccgatatctgcaagaagatttgtccccttgaaatctccaagtcggtttacgatagccggatatccctgcgggtaaaggctgcatcccacaaaacggagatgatactctttgctgttaaatcggtaatggacttctggattctggagcagataggaacggaaatcttctctctggtttctgatccatgtcagaggaagcccggcagccagatgaacgtctgcttcacggatggaaaagacattcagttcccttgcaatcgccatgagagttagaagataatattcttcgtccatagctttatctgggataaattctttgtgtccttcgccaatccggtagtaaatgccgttatattccagaatattcccggtgaagatgggttctgtttcataggctttgattccggttggtgtgacggtatttgctgttttcatgttgccgtagccgtgatctacagcaatgatttttgtgtttctgagttctcgcataaaaaacacctccattttcgtattgattaattcagcaggctgtaccggtgtggtactgctttgctgtgagataagcatacgaaagttggaggaaaaagacattgagggaaaattgagttggaattgaaaaataggatataattttgtaaaatagagcaatttctttagttttttatagccctgcatttttttgttataaacgttcattaaatgttgacatgttattatataaaaggtaaaattgtacaataaaatgtggaaagttggatgaaatttattgaattataataaaactaatcgtacttaactggcggcttatgtatttgtagaacttagaataatagaaaatttaaaatattatcaatttttacagctgttgcaatgctttcagtaggaacaacagtttttgcaagtccttaactgttgtttgataaggagtgtagttttatacaaatagtgatattattgcaaaaaactaggattttataaaaataaaaaaatcaagtctatagctgtttgaagtgaggagaaaagcgtatgagaaatgtgttggcaacggacataaaaaacaatattcgaagcattcgctttattttggggatttttctaatcgtttcggctaccctgatgtctgagcatgagatgttgcagaagatcataaatgcaggcggatctgcagaaggaccaggctggttcgtagcatacacctattgtatgaacagcgttaatatgcttctgtttgttcccattgccgttgcttttgcgggtggagagaatacggaggctgagctgcacagtcgtttttttctgttcagttatatccgttcagggagaaaacagtatctcgtaggaaaagcagcaggattgttggtctccggaggtttgacagcttttttagccatggtgttccttcttgtaatctgtatactgaggttcggtcagtatccttctctgattgacggaaattatgagatggcagtgcttgtgggcagaacggcggtaagctttctgagattgtttttaaatggcgctttttgggcgctaattggcggtacgtcggctgtcataacaaaaaatcgctatatgtcctatgccgttccttttattctttattatgtcctgaccgtatttcaggagcgttactatcaaaaagcattctttctgagtccccgctattgggcggcgtctatttactacaatgatatcttctgcattgctatattagcggttggaagttttttaacggcactgatctttatgtgcgcaatagaaagaaggttgcggtatgcgtgatattaaacaggctttttggattgcaggccagaatttctatggatggaaaaaaagtccgaggatctggatgacctttattttggcagctatattatgtctgatgctgtcggatcagattatttcccatgcgataaaatatgagacaatccttcaggtattcgagccgtttatttggacatatggggatgcatcctctgttatgctgtcctccctgcttttaatcctgctctttgcggacatgccatttatcagtcaggcaactccgtattggcttgtacgcacaaaacggaagatatggcttgcgggtcagattatctatgtgatcctggcgactgtgatctataatatttttttggctgtgatgcttggaattatgggagctcccttttcctttacgggaaatgtgtggagcgaaacagcggcaatgttgggctatggcggtggggagagcataaccgttcctgtttccataaaaacaatggaaagctcaactccttatatgtgcgcagcaatagtgtttggacttgtacttttatatactctttttatcgcagttctcatgttgtttttaaatctggctgcgggaaatatggcaggggtgatcggtgcttttgcagtcagtctgtatgggctcctgctgaacccagatgttttccggaaactgtttcattttacagaaagtcaggaatatagggcgaacgtgttctgcggctggctgtctccgttgaaccaagctacctttcccatgcacagctttggttatgattacctgccagggatcgggatgagcatgttcatatttgcaatattaatcatagcgctgatcggcttgtcagccgtccgaattaagggctataatttctcttttacgcagacaaacgaataaatggagggcaaaatggaatatgcaatcaggttgaagggactgacaaaatcctttcaaaaagaaaaagtattaaagaacattacccatgattttgaaaaagggaagattcatgggattatggggtttaacggttcagggaaaaccgtaatgtttaaatgcatctgtggatttttacaacctgagagcggcacagtgctcgtagggggaaaacagatcgggaaggagctggactttccagattccgtaggcattatcattgaaaaccctggcttctttctggatctcagcggttttgcgaatttaaagagactggcgtctctgaaacaccgtatttccgatgacgatgtgagggcgacgatgcgtgccctagggcttgatcctctgtctaaaaagaaggtaggacagtattctcttggaatgcgtgaacgtcttggtatcgcacaggcaatcatggaagatccggagcttttgatattggacgagccttttaatggtctggacaagcagggggcaggagaggtctgcgagcttttgcggggattaaaggaacgagggaagactattcttatcgcagcacataacatgctggagatcgaatggctctgcgatacgatctgtgagatggatgcaggtgtcctgacgcagataaaataaaaatacgggggaaagaatatgggaaaggtattaattaaatgcattcaaacaccaatgcagaaatatttttatgatcgttctttggattctgtagttatggtgaatgatgaagaatatcagatattaaaaactgtggaaaagacaaaattggttcctgatggagtgttaagacggtttgtgaaaagcggattattgcgtgagactgcgatagaagaaattgagcatcctgagacagaaaacttacatttgttggcagaacattatatgggcaatctgattttgcaggtaactcagcagtgtaatttgagatgcaaatattgtgcatattctggaaactactataatcgttcccatacgtcaaataggatggatttcgagacagccaaaaaagcaatagacttttatttgaaaagaagcgaaaaagcggatcaacttgcattatcattttatgggggtgagcctcttctggaatttgaattgattaagaaatgtgtttcctatattttacaacgtaaaggggataaaaaaattctttttactatgacgactaatgggactttaatgacagaagatgtcatagaatttttggtaaaatatgagtttaatcttatgattagccttgatggtgataagaaaagtcacgatataaatcgaagatttaaaacaggaaaaggttcatttgacattattttagaaaatttgagtagactgaaagcttacaatgaagagtactattcaaaagttttgtttaattgtgttattagcgtaatgtactaacaagttatagttactagtacatagaacagactgccttatacattaaaataaataaggtagtctgtttctaaaaaatatacgaaaacgttaatagtgtcaggaaggtatttataagttaaagagtttataattgaagtttcgtgaaaaagcgacaattctataagatatatggaggaaaaatgaaaaaaagtgttctagcaattatggtaggtgcgttgtgtattattctttccagctgtcaggaaacaccagaggagagttcggtagtcagcaaagtggatgggattagcgaggcggctgtctgtgaacctcttaaaaaaggagaaaagagagagacaaatgttccaacgcattggaaatttgaagaaaagaaaagcaacgaccgtgtggttatccaggcagatattaagttgggcgaacaaagcattggcaatcttccagtcatagagatgcaaaatcacgagttaacgcaggaagaactgaatggattgattgattattttacggacggtgaggaactatatatgccacagatggtgacaaaggatgcgtatcaggaagtgttagacaggatttccagcaaggaaggaagttacttgcaatcagcatattctacatcgattgcagggattcaaaacgcaacccgagaggggatggagcttgcaccggatgaagcgtctgcaccggaaaagatggagataaaatttcaaaaaaaaacagaggatcacggtgtggaagcggcacggagttggatgagtactgaattggaaaacacagatacagaggattattttactgcagatgtgggcgaggacaggaaggcatatatagaagcagagcggtataatcaggaaattgacaatgacagtagttttctctggatggagggttctaattttatagaagaagaaacaatagaaactgaggaaatgcagagtgagtattacagtagctttggcatggataccaacggctatacagagaaatttcatgaactggcagatgcgtatcgaaagtgcatggacaagatcacctttacagaggaagatggaaaggaacaggcagaacaagttttagaggatttaggtatcgatggaatgggccttgtagattctgatcgtaccgtgtggttcccgaatggcgcatgttcagagcgcaatggtctgggacttggtagtgatgctttgtggcagggagatctggatagaggattaccgggatatctgtattgtttttcgaaaagtgtagagggtattacttcagttcctgatggcgtggttgcggaagaaacagtggatagttatgtgcctccgttccaggtagaaacaatctctattctgataacagaggaaggaattaaatattttaaatgggatgggatatcggaagaagtctgtacggtgacggaaaatacaaagcttctgccttttgaaaaaatacaggcaaagctgacagatcagattttttattggtattccggaaaaggccagtctgccaacgacactaccgcactggagtatgatgtggtaaacgcaaaattgcagtatacttataccacagcctatcaggagccgaaacacgcatggttggttccagcatggatttttactgtcagggaaagtattggtggaaattctctacaggagctttcttatgtgatcaatgcttatgatggcagtgtgattggagaagcatattagggttcagcgacacttgaatttttattgaccatagaattacaaggtttatcatgagaataataaatatgcgatatttggcttggatatataacaggtaagaataggaatagtgcaaatgattaagctcgcattgattgataacggtataccttatcatatgagaaataacaggaatcaaaggattgttcataaatcttttttggcttctaaatgcgatccaagtgagtataaagatgataaatcattccatggcgctgtatgcgtcggaattatcacaagcatatgtagtgatatagaattatgggacttgaatgtgactgactctgcaggaacaacacagatcacagttttgctggaagctttggaatggtgtattcaaaataaaataaagttaattcacatgagtcttggaacaatcaattattttgatattaaacccttatggattcaaataaaaagattacttgatgctgatgcgattatagtagcagcatatcataacagaaatataaagacttatccagctgcatatccaggtgtttttggtgtcaggcaggatcgttatggtcttttgggaaatggtcaaattctgtttcaagaacaaaaaggttataatattgagaattctattatagcaaatttttcgtggaatgggatcgtaaatcaagccaatagttatgcggctcctgttgtcactggacatattgctacatatttaaacagaaagcccacagcaggatttgatgatgttatggactttttgatgactatagcaacgcataaatctgattatccggatatactagaaaatgtaataagggataaaaccaatatagagataccggtaattgccggtattgatttagattacgaggaaatgatacagctaaaagtgatgtttagtcagaacggttattacgcaataaatctgcagaaaaatcctttagatgaaaatgtaattcctttagaatattatgacgattccaatgagtcattgaacgatatcctttatacagtatatatagcttatgaacctgatattattcttttgaatcaagaggaagaaatatttgaaagtagtaaggcatcagatatagatatgtatattgtgcgtaaaaataatatgtatgaattgtatgcagaagatcgaataggaataacttacaatatagaggatatatatgagcttgtttgtcaatattttgcttaacgaatagtgaggatggcaattggatatgagagaaaatgggaaaacatggtatcgaatttgtaaaatgttgtgtgaatataaaaagtattttccagggattatctgttgccttttgggttcatcattcataacgtttatacacccactgcttataagacaaataacagattgtggtatattgcagaaaaacatgaaatacattcttttattttctgttatattaataataatttctttaacccagcaagagttaaatataatccaaacaaaattattttcaaatgtacataatcagtttacacattctctctataaaaagacttactggaaaatcaataggatgaaaatacagtattttgctgaaagaggaagtgcagagattataaatacaattggtatggatattgataatgtgtcatctgttgtggatcagattactcagttttctatatcatcaattctccaaataataggaggagtagttgggctgtccttattagactggaaattagcaatattgatagaagcaattattccactgaaatttataatagtgtcctattgtgcaaacaagaaacgggaagtgtttgaacagtggattgaggataaacgaaagtttatgagttggtttgccgagtgtataaatggaattcatgaaatgaagctctggaatctgtttcaggtaaaaaaatctcaatttgaaggtctgcaaaaagatttgatggattcatataaaaagaacgcaatgctagatgaatatagtactgtcagtgttgtagtaatagacacggttgtaaatgcgttattatatatattaagtgggctttttataataaaaggagaattcactataggcggagcatttgcttttattacatatagtgcatatgttgtaaatccaatttcagcattgataaacattaaatattattttgcgcaaattgagccatcggcaaaacgtctttttgagttatggggacaaccggaagaattggaaatgaaattatgtgaaatgaaacctgagaaaatttatcaagatagggatatggtttttgaagtaaaaaatcttgtctttggttatgaaccaggacaccctattttaaatggtatttcactatgtgtaaaaaaaggggaacgaattgcgatcgtaggagaaaatggaagtggcaaatcaacacttttgaaccttttggcgggattctaccggccacaaaaaggaataataaaattgtatggagctcctgtggaattgatggatatacaagatatgagaaatagaattgcggttataagccaaagaccatatctattccaagggactatagaggagaatgttaatatcgatggaaaggcgtcaagagatgcagttgttgaagcatgtagaaaaagtggtgctttaggttttattgaaaaattggatcatggatttggacaaaaaattggacaagatggtgcaaaactttctggaggagaaagacaaaagatagctgtagctagggctctgctgaaaaatgcagacattttacttatggatgaggctacagaaggatttgatgttgaatcaaatgaagctttacgtgagttattacatagtgaattaaaaaataagactatcgtttttattacgcataagtataaagaactggaaagtgttgataaagtatatcgcctttcaaaaggaattttagaattggtgcggagttagagatataaatttctaatagaactgagccactatgcatttgacatattgtatcaaacagtaggttgatgacgagatgattgtaatgtatcgcagattgaacaagcagaggagcatatttacaagttctcaggcattgatgaaggcaatatacctagactataaaaaatttgagataggaggagcgaaaagtgtcaaaaaaagaaaagtgatccttatgtaaacgctccatgtctaagaaaaaatggaaatggacaagcgcctagtcttggagtgtatctcaaaactaggcgtttacattattgaggcaatatattttacaagtgtttgtaggaaccgttagtgcttggtgagaagaatactttttgccagagcaattccagcttgtggatacaattcttgaattgcttgatatttttcttcaatcaattcgggttcgtctgcccatatatcctcataaattttcaaggcttttttaaaatgggttttcgcttgcgaaatatttgcagtgatcaggcagatacttccaagggattcctgtacctgggcataatccaaacagtggtttgaattatattctttgataatctgtgctaatttctgaagagcagacagggcaaggtcaggttcttgtatttcaattaagaggacagcataattattaatctgaggaatactgtcattagtataaagaagctggtattgttgtaaaagagagatacccattttcatgtgccttttagcgagatcaagttgtccgttgattcggtaaagccctccaagattggaatggaggttggaaaccaggtgggcattttcttttgtggtttcttttatttgagcaagtgcttctttttctaattttatcgctttttctgttttgggttccagagttgcctgataatccaatagtaaggcacggtcagatgcagtcccgtaagtatttgcttttataaaatgctgtagttcctggatgatttttttcatacccttttgatagtggtacttctccatatatggaaaaacatcttctaaaaataacaggtattggggaatatcgtccttttcaatgaaaagcatgatgttttctactgtttgaaataattttttataatagctaacttcaatgccatgcatcaaacatattttttgcagagaatccaataacgtgtggcagcttgtaacagaaggtgcggtctcggaaactgcaatttcctgaatcattggatgcagagaaatagtatgccggagacttgactgtacaaaacctgtctcgatcagatcattcacgtcatttaaagtaggcagctccagccatttggaaaatatacgggcagaaataccagatgaaggcataaaacacatattgcacataatatcctgctgtttccgtgataaggagtataacgaaaacagggtatggatatggttgtaataggtggcttttttgctctgaccatctttcattactttaatcttatcttcattatgaagagaagccttttcctcttgaagttttatcaataattgctctggagttaaaattccattttccagaagtttggctgccagttcgacagcaaaagtatggtagtgtacagtttctatgattttttctacgattgcccggttttcctctgcttctgaataaaatacagatgtcagttgaaaaagagtgggtatatctttcagttcttttaattgaaaactacagtattcagacagttggcttctggttgtaaataaaacccggcaacggtattttaatacgactgacaggcaactgtcctgtgtggatgtgacattaaaattgtctatgatcagcagtgtatcagatttcaaagagcgtaagaaacggttatgtctttgaaaacgttcctgctcactgatttctggtggatcatcaataaaatccatgtctacaatatcttgatatagattaccggtgtattccatatagagaatattggtgtactgttttctgtattgctttgcataggctttagcaagctcgctttttccaattccggcaattccataaagaaatatatgtcggttctcttcaaacaaagtatggagttcatccagttcttcttctcttcctagaaaatgacggcatggttttgggacttcgctgtccataatgtaatccagaacaatcggagatagaacacctcctgcaatcagtttttgatttcttgtatcacgtttaataaattgccgttccataccaaaagaaagtacttttgctaaaaacaacagccttgaatcagaaggtttatatagagatacaagttcctgcttttttgtatccgaaatcgtatcgtcctgtatgaataacgtgtaaatgtcctgtataaccatgttgcagtctgccattaagggaagtaagttccgctgaatggttgttgccagttttttctgattgctgggttttgcataatatgaggttattttgggactgatttttgcttgtccggttatccagcggcaaattagaccattatccatagaaaaatcttcatttatcggatcattcataaaatcttcaaataattcgtataaaaaatcaggttggttcatctgattgctttcactgatttgattttttaggcatgtgctaatagaagaaaaatcacatcgttccaacagaaatccctcctttggttttcgtgttttatattcttaaagtctttttattataacacgaacaaatgttccggacaataggaattgatactgtataggaagaaaatgaatcttaaaaactcaatctgcggtcaatttcaattcaatgtgattggtgcagaataattttagaatgtaatcaggctttcgaaagccgaattcaattcatacagaacttttgtacaatcctgccggcataggatgtagagagaactgtatgctgaaggaggcatatagcatgaatacgttatttgattctgtagaagttctggatacaaaaaaagaaatccaaaaagagaatgtaagctatgaacatgcaggatatcagattcgagtgcattttaatggggaaaagacattgatccagtgcattcagaatcttactgaacgaaaaattgcaggttgattttcttaagttcttgttgtaaaataaagacaattaaagacaatgactacgcaagaccgatgaaaagagggatagaatgtatcaggcaggaatttattgccgaatttccattgaagagcaaaataaagagggtgaatacagcaatagtattcactctcagattcagatggcaagagattatattgcagagaataaagatattgcagagaaaaaagtttatgtagacgatggggcttctggaagtaattttgaaagaactgaatttcggaggatgctggcagatattgagcttggtgttatcaatatggtgatttttaaggacgtatctcgacttggaagagaacatattgataccaactattatctaggcaaatatttcccggagaaacagattcggattgtttcgattctggataattatgattcagccgttggaacttatgatgaaatgttagaaataaaaactttgctgaatgatatgtatttgagagatacataaagaagaatatctctcctataaggcagaatatgaaaagcaggataaagatatcagggcgaagattcagttggcagaacaagagaaagacagctttggagaggcagaagaatcttatgaaaactggatagagaaatttatcaagtatggaacattatccgaagtgacaagagaaattgtgacagaattgattgaaaaaattgttgtgaatggagataagagcattgatattgtatttaagtatcagtcgccttatccggtagaaaaacaggcagtgtaaagactgcaaatttttttacagtaattttcccctagttataatgaacacatcagggagactcattgttggaaacttatatcagcaacgtagtgaatgtgggacgttctgtcatttgtgttggaagcggaaataatgggaatgacagaatccatacggcgggacagctgcgtcagggacagacagagacgatagaaatgagcattgggacttatgagacaactctgaatctacaactgtggaaagcatatgcagacgagattgaaatttccatagaaacgccatccggtgaacgactgccgacgctttctgaaaaaatcggtacacagagatatcgtgcgggggaaacgaatctgttgatttattatggtaaaccagggccttttcaggtgacacaggagatttattttgattttattcctgtggggacatatcttaccagcggaatctggaagattcatctgcagggaaaacgaatccgggagggtaactataacctgtggctcccaggaggaaacgtcctgaacccggtgactggattttaccgaccggtggcatcggagacattgacgattccctccacggcagcgaaggtgatcacggtaggagcctacgactccagattaaatgcctatgcagacttttccggtcgcggtggagagagactttcttatccaaaaccagatctcgtcgcaccaggtgtcaatatcactgcacccgtaccgggcggcggatatgctaacgtaaccgggacatcatttgccacaccatttgtgaccggatcggcagcacttatgatggagtggggaattgtaaggagaaatgacccatttctatggggagagaaggtaaaggcatatctgagacgaggcgcccagccactgcctggttttgagaagtatccgaacgaaagtgtggggtggggggaggacgttataataaggttacattgaagaaagtcagtaaaatcaagtgtttccgttcatttttccgacacagaaacgaagcgctttcaccatgattttgaagaaaatctgcccgggttggattcaaaatgatatggaaagaaagatttgtagcaatgacgtaacatgaacatctggttttgttacagataaaagtttaaacgaaagagaggtcacagtaatatgaaactgacttatacaaatgtaaatgaatacctgatcccgaatctcacctataaatccggtgagcagatggagcaacttggcaaatatggattcttacgcagagattatctgaaaaaccatcgaaattcaacgtatcaggtgatgcttttacaggataccattggagagcatcttctggaagtggacaaggcagctagggaacgggaggaggtaattctgaaacagttggaagaaaaagaaccgctgccggataaggagaaagaccagatggcatgggtaagagctgccaatcagcacagagcgattgcggaggagattattctcaaggaattgatttatgtataaggattgccagtaactaatctggcagtaactgataaaaatagaatattgtgagcgaagtaaggcgtgagtcataaaatatggcttgcgtctttttctttgcctgaaaggaagtgataagtttgaacaagaagtttttgaagcattatatggaaaccaatccggaagggacagcacagacctatatctttctggtggacaatcaggatatagcgttgaatattgtgatgtcaggttatcaggcactttgtctggtgcaggaagatgacgggtattatttcagtgcagattcctttatagaggaaatgaggtctattcaatttactggaagctgtcagagtgcctatcattatgtgtctgcctgtacggtgaagtggatgaatgataagttacagacatttttcaaagacgctggtctcgacggaaaagcaggctggcagttgttcaaagagaaagagtatcttggcaaactggataatcagaaagaagttgagaaattactggaacagtatattctgcgttttgaacgagatccgagagaagaaccggaactgagtcgttttcacttatttgatgcaaaaggaaatgtgaaaggtgtccgggatatggagattgtagattatctggtggagaatgttcagttttttgtggtaggaatcacaccgtattattatgagcatggcgttttcatggaagaccatgatggggtaagaatgaaataccgtatccagaagctgatctatcgagatcaggtacagagtggagtgatcaaaagaatctataatctgctgattacacagccaaaagttcaccgagaggcatatgaactaaatgaacagcctgtgcggtggatcaacttcaaaaatggatattatgatccggttacgggtgaaatgctggaacacaatccggattatctgacaatcaatcagataccatttccctattatccagaggattgtgagcaggtgttacaaggtggagaaaatatcaaaaagtatcttgcatcttctcttccgaacaaagaagaacagcagacattctgggagtattttggatactgcatgacacaggatacgcagtttcagaaattccttacactgaaaggaaatggtggaacaggaaagtcggtggcagtatcgctgatccagcatgtcgttggaatcaccaatatgtccagcatttctttacaggatttaaataaacgattctatgcgactggaatgtatggaaagctgttaaatgcctgtgcggatattccatgcaaggcaatggagaatacagatgtattaaagaaagcagtcggtgaggacacactgatttatgagaaaaaaggacaggatgcaattcatttccactcttatgcgaagctgcttttttctaccaatgaaatgccgcagaatcttgaggataagtcagatgctttttaccgtagactactgattctcgatatgaaccgggtagtaaaaagtggtgaaaaagatctgcacttaaaggaaaaggtacaggcagaatctgattatgcaattcatatggcgatgattgcattgaaaaatctgtacgaacagggaaagttcacggagagcgaacacagcaaagaatgtgtaagagaagtgcaacggacgtcagatagtatctgtgcttttattgatgagtcattggtgcgtgccaaaggaaaacgtctgaaacgaagtgaagtgttccatatgtatgaggaatactgcaaagagaatggcagacaggggcatggtaaatctaactttttcaggaatatgacagataaaggtttccttctgaagcagtacaatggtgagttttattatcaggatattgcagttaaggaagaagatttttgtcctgtagatccagaagaaagaataccttttgaagaaacagatacagattataaacagttacagttaaatatgaatcagggaattaagggcatttagggcaaaataagcaaaaagaaatgttaccggagcaggagaaataacaaagatagctgccaaagtacataaaattttgctttttttacactgactgccctttttatgtatcaacattttagctgatacaaatataggtttttcccgaatttgggagaaagtcaaaaataaatattaagaaagtatgaggtatgattatgagaatgatgaaaaacaacaataatgagacagttatggtgatcgggattgatcatgggtatggaaacatgaaaacagccaccaaatgctttccatccggtgtagccagatatgacaaggagccaatcttccagaataatcttcttgtttacaatggcatgtattaccagatcggagaggaacacaaggagttctgtgcagagaaaacgcaggatgaggactattatgtgctgacactggtggctatcgcaagggaactggatgggaaaggaatgaatcaggcgaaggtgcacattgcagccggacttccgcttacctgggtagctacacagaaagaagatttccagaaatatctcctccagaatgaaagcgtggattttatattccgcaataaagagtatcatgtggagtttgcaggtgctgacatttacccacagggatttgcagcagctttttaccgtttacaggatttcaaaggaatcaacatgcttgtggatattggaaacgggactatgaacatcatgtatatcaataattcccgtccattagagaagaaatgctttacagagaaatatggaacgcaccagtgtgtgcttgcagtcagggaatctttgttgaaagaactgggaacagtggtggatgatctggtgattgagcaggtgatccgtaccgggacagcagatattggtgagaaatatctgacagtcattcgtaaagctgccggagattatacgaaagaaatctttcataagctgagagaacgggaatataatccagaactgatgcgtctgtatgtggtcggcggtggcggttgtatgatccagaattttggagaatatgacaagagccgtgtaacgattgtacgggacatctgtgccacagcgaaaggttatgaagcaatgagcgtaaggaaaatccagagaaacggagggatgcttgtatgagaaaagaacggaaaatcatcaatacaaatatccgtttgaatctttgtgatgaacaggacaggcaggcatgggaatatttgcagacgatggacagggaaaaatataaatcgtacaccagagcagttgtagttgctttaaacgattatttttccagagagtacaggaatgaagcagatccgtatctggaaaccagagaaaaggaagatgcttttctggaaagagtggaaacagctgtccgggatggagtgaaagaatctgccccgatggctatagcgaagaatctgatggaaatgcttgtaccgtttgtaaaagaatcggtaggagaaattaatctgccggacagaatactaacaatggaaaaaacggatggagagatcgcagaagataatctggactgggagaaagaagctgatatggatgcagcactggattttgcagacagtttttagatggttatgaaatagcagtaacaggaaaacagactgacagtaaggaatagctttacaaaaacagaatagcagaaaaagacaatggcagtggtgacatttcagacattatgaattggagaaatgtttatgactgctatttttatgttttttagcagaaatggaaagagatccagaaaaagaaagacagaaatagcaggaaaatataacagaaaagcgttggcagatgggtggattgaacaagcaaggcgaagaaaagaatagagtgccggatacggcacatgattgtccgatacttcgcatcggagtgatgcacgaacagcctgtttcagaaagagaaaatctatcgaaaggggagcttttctctttcttccacagtcagttcctgcaccacaaaaccaccgtcatctctatttaggttggataacgcagaggagaaatgttacttgactggtgctagttcagtggtggggagatgacaggcaagtttcgcaaagtggcaagccactctgcaccggagccagcctttgggctgttcctaaacttgccagagggctccgccccttggaaccccggcacgtcaatagcgtaagtatccctgcgaaatgtccaccggacattcctgcggaacacttactgattgactagggttttaccctgcacccaccaaaggggcgttgccccttatggaattcctgtaaattttagccgaaacgctgtgtttgttaataaagaatgaaaatcaagcaaggaaaggagacaaaagcctatgagaaaacgaaatcatacagtaaccatacggatgaataaagcagaatacgatctgcttcaaagcaaagtcaaagaatccggaaaaacacagcaggaagttgtgataaaagcaatcgcagacttgaagatagcatcagtagaggaagtggaagaactgaaaagactgaaccagatgtttgcagatatcctttgtcagctccggggagcgactacaaatatcaatcagattgcaagaaaactgcatacagatggagaaattccaaatgacagtatgctgtatttcctcaataaaaatatcctcaagtaccggaaggagagtgaaagggtatggctgttaataagacgattaataagcggacaaatacacatggagcaatgagaaattgtatcgaatatgttttacgacaagacaagaccggcaaactgcttacctatataacaggcccgtactgccatgatgagattaactatgatttggtgtacagaacctttctggaagaaaagaagatgtggaacaaagatactgggagaatgtatgtccacaatattatttcctggcataaggacgagcagattacttcggagcaggcattagaatttggaaaagagtttgcagaaaaatggttcagtggattccagaccttagtggctgtgcataaggataaagagcatattcactgtcatctggttacaaattctgtgagttatgaagatggaagaaaactgcataacaccaaaaaggatctggaacgtatgaaacagcttaccaatcagatgtgccgagaacgtggactgacagtagccgaaaaaggaaagcactttgatggaagtcaaattgaaaaaggggaagtcattgcatggagcaaagataaatataatctgttccgacagcaggtgaaagacagctttgtagcggattgtgcaatggcagtgttaaaagcactggaaaattgtatcagtaaagaaaagtttatagaaaaaatgaagcagtttggatggaatgtaaactggacagagaaacggaaacacatcacctttcagaaccaggatgggaagaaagtgcgagacagcaatctgtcaaaaacatttcatctggatatcagcaaggagggactagagaatgaatttaatggaaatagggaaaaatccagagttgcagccgacagagacagcagagcagacgaagaactcagaaactattacagagagcttgacgcagccatcaaagacgccagaggaatcgccgatcaaactcaaagtggagagggatattctcgtacagagtttcgagaaagcgaaagcgttcatgcgaacacagaaaaagcagatccagacactggaagaagagaaacagacgatcttatccgacaggcagagattgcgagaagaagttcggaaatcaaccgtagaaattcagcgtctaacaacagaactgtccgaaacgcagaagctgaatcaatcgcttcagcagagcaacgacgatctgaggaacaggaatggtttgaagagcaggagcgagcaagagcagctcgaagaagaaataagagacgttcgggaccagaactctaaacttcagatacaggtgaataaatcatctgttgaagcagtagatgaagcacagaagaaacagaaagaagcagagaaaaagatggaacaggcagaaacaaaggcccgtaacgaaaagaaacgggcagagctggaaatccgtaaagcgaaaaaagaagtaaaagccagaaccgaaaaaatgagggatacggaatatttttggggaatgggatacattacggtaatcctgtttgtaattatacagaacggtgcttttcaaaatgatttcatagattttttcaggactccattcatgtggtattttcaattttgtgaatggttggcacatccaacctatgataacggatttaaccagaaaatagcatatacatgtggagaagcatgggttatcagaattctggcaatcgtagctgtccttctcatagtggtaattataatggcgataattatggaaataataaagaaatacaaaaaaatgtgggataaaatttcacagatgtttttaatcggaagtctttcggggatagcagtacttggagatgtaattagagaatatctgccagtgaatttgattttgacatttgggtttatcaatgtgggaatcatgttgcttaaaatatattttcaaaagaagtttgaagagaaaagcctgtatgctgataatcactatgattaggaaaatacaaaagccgataaccacagttcaagaactgtgtattatcggctctgcggctgtgcgtctggcgttttaatagcagttatatggaattgttcaatgtcgattaggcattcgcttttgcacttcgacaaaagagtggaaaatttttttactggctcattttctcagattttgtcgcgtgttttatttccgtagacagggaaatgcacccactcgacacttacttttatttgagcctctactttttattttttccttgaatatcctataacactaacaaaatacgatgcaactactatacccaaaacaaaaatagcaatcaacatagaatttttaaccaaattttgagtaacgtatttcatatcttttgatattttacttacgaaaaagataacgagaagtgtgcaaatcattctcacatactgaacactcatatagccaaaccactgtgctattgctaaacatatagaacaccataaaacaggtaatgctattgcaatggcgatagaaaaaccaaactggctaagcgtaaaattatgataaaccacataacgaatgatataaatgataactgtacccattatactaatcggaacaagaagcaagctagtcaaatacttactgaaaatgatttggtacttactcagcggcaaggttaattcatattgtttccatgaagtcaatccatcataggtcatggtcatcattaagtgcataccgataaaaagtgaaaaaaaagccgatgacataattgagtaaacttcattctctccgaagaatgaaattgctattacaaaaaaatacattacaaaaatgacttttttattcattttcttcataagcaataaatccttaaaaaccaatcctttcatttgacacctcctttgatatagaacagcataatgtcctcaatagaagcattatcaataattagattttggtatcttttttttgcagctactttgtcatgtattaagcattccacgctaagatttgtttctcgacaacatacatagtcatctggtgaaacagtattaaattctgattttttacagcgtataattccataattataaatgaggtcatctttctttttctcaaaaataatttttccattatgaatcagaattacatagtcagcaaccttttgtatgtcagaggttatatgtgtagagaacaaaatagagtgttcttcatcttgaataaattctaaaaaaatgtccaaaatttcatctcgtacaacaggatctaaccctgttgttgcttcgtctaaaatcaaaatctggggtctatgcgatagtgcacaaataattgacaatttcatcttcataccttttgaaagttgccctattgatttatttaatggaacatcaaggcgtttcatatattcttcaaacaaattcatatcccatgttttataagatcccgaaaggatttgggcaatatcttttgcatttaagacggaatggaatttacattcgtcaaaaacaacaccaatgttttctttatgcaaataagaatgattttgtttacccaatattcttatttcacccgcatccaacttcaactggtctaaaattaaattgatagttgtactttttccagcaccattttctcctatgaaacccacaatacgtcctgtaggaactgtaaatgaaatatgatctaacataaaatcatcaaattttttagtcacattttttacaacaatactgttctgttccataattccacctctcattcttcaaaaaatagttttagaatattagccatttgctcatagctgataccatgggtacgaccgattatagcaaccttttctaaaagttcttccgctattcgtagttgttcttcttgaataaattctttatttggtgatgcaacaaaactaccttttcccgatacggtttcgataaacccatctcgagttaaatcttcgtaagctcgttgaacagtaataacacttatatgcaggtcttttgccagtgtacgcatggaaggcagggcttctccggcagatagggtatcattcatgattaaactcttgatctgcatagcaatttgttcataaataggcttatcactactattacttatgataatttccattctaatttcctctcaccaccttctgatatatgcgtacttatacgatatgtacagtgtatatgatagtgtcagaaatgtcaataaagtaatcctataattcattaaaatataccatataaagttttcaaaaaatcagcgcaattcaacctgtcaaccggcataacaaggttatttctttgtgcaaatcagcacgataatgataggatgagcgatgataaattaagaacttctggctctatggaacgaaatcgtcaaagctgaaatcgaacgtcgtgcaaacgaatcaaattgatcatatgtgaattgtcaaggtgctccggctactgaaaagtagtcggggattttttctatcgtatctaaaaattaagcggttaccatatattcagattggcagtgaagtagttgttaaagaatatccagatagacgggaatatgctgtttgggaagaggtgcttaatgcttgtttgaaagaaaaatatattgaaagaaaaagcgaagcgatttgtgtaattacaaatgcgggctataaagtagttgagtgatgaaaaatacatatagcagaagagcattagattaaaaaagaatagtaactccccattattggaatattttccagttttggggagcattgtatttgctatattcgccattttttcttaggttcatattttccacaaccatcacaggtctgcggccagttgattttccattcaaaatattcatctctggtaattgtaccagatttcaattcttcttttctgataatccattctttcataaaatcattcagaaccccatagttgaaccatagaccaacaggtggatgagcaggccagttatcagaatcgtgataacggacagcggtatcctcattagaattgcacttttcgattggataggtttctaactggaagaggttgatcgctgccgggttaaattcatcaatccagaacagaatttccataagttccgaagcatccatagtagtaggttcgtgcagtgccagcggattcacgtccagaatcttagccatttcagttaccagatctttgcggggaacccggtaattcgtttcatattgggcaaggcggtttgcgcctttatcgccccaaccgagggcggctccaagttctgcctgtgtcatatttcggaatgtccggattttttttattttatcaccgattgtcatatcagatttccaactttctttttgataaatccattttactaccaaaaacagggaatgtaaacagaaagattcgcattgaagcgaataaaacacttgacattcgcattaaagcgaattaaaatgacggtacaataaggttcgcattaaagcgaaacaaaagaggcgaatgtaaattttttatgaatttttcaaaaaagggtgtcaaaagtgcctctgtaacgccttattagtgagaggatttttttgaagcgaacaacattttggtgtttccaggctgtaataagtgaaaggatattcaaaaaactctcttttgtaccttgaaaactgcaagagctgtataatctgattccacagatgccataaccctgtaaatgattttacaggcgagcgtcgaagatactccggaaacggctggtaagtttgcgaggaagctaccagcattcagaaatactttgatagaggtcagatgtaacgctgacaacagattatacgaatggaagccaatacgctgaacagaatacaaaatgctatagatatctggataactggagaaaagaggaagaaagataaggtgatgcggttgagaaaattgtaggtataggacgacttatacaaagaatatgttggaaaaagaggtgagcatcatggtgaatcagtcagtaatagattccagtgttgatctggagcagttaaaggacattgaagatttaattcctgatatggataaagctatttctgagaaagtggaaacttttctggataaatccggcgatcagccgtatgctcacatgaatgaagggtatgtggtggtcgtggaaatgaccggagaaatggatgccacagatgccattagcgattatcttagaaaaagaacggagttgatgtattagatgcaagtcttgaaaaaatatcttgcgaagctacagatgttatgttaatgtgaggtcagggaaaatgaacgtgatacatggtttctgacttcaaattcaatggaataagtaagttgggagcgatgtaaaatggaacagatgcaaatgaatatgccagatatatacgatgctgcattgtatcttcgattatcgaaagatgatatggaagagggcgatgtgaagtcagagagcaacagcattgcaaatcagagagagttacttcggagctttgtaaaaagccagccggatattcagatctttgatatatatgtggatgacggatactcaggaggaaattttgaccgacctgagtttaaacgaatgacaactgatatagaagctggaaaagtaaactgcgtgattgtaaaagacttatccagattcggaagagagtatatagaagccgggcgatggatcgaaaagacctacccggctttaaatgtgcgttttatttcagttacagaccagtttgacagtaaaacagcagatttttcagaaaagtcatttgttgttccaatcaaaaattttgtaaatgaaagctattgccgggacatttccggtaaagtgcgaagccaccagaaaatcaaacgtgaaaaaggtgaatttattggagcatttgccccgtatggttactgcaaagatccggagaataagaactgtctggtgattgattcttatgcagcggatattgtaagaaaaatattttcatggaaaattgatggattcagtcttggagcaatcgcagaaaaactgaatgtacgttatgtgcagtctccaaaagaatataaaaaggcaaatggcgagaattataattctggatttcacagctcagacacaccgaaatggtcggcagtgcagattaaaaggattctaaccaacgaggtttacattggaaacatggtacagggcaagcaggaacgaatcagctataaagtaaagcaacgcctggataagccagaatcagagtgggtgaaagtagaaaatacgcatccggcaatcatcaggcagaatgattttgatgtggtgcagaagttactccaatatgatggcagagcatcgaaaacatcagacagtgcaaacttttttgggggatttgtgttttgtggagattgcaagaccccgatgatacgcagggtaaatcagtataaggggaagaaaaaagctttttatatctgccagacaaagaataaaggtggagattgtaccagacacagtattccggaagaggtgctgaaaaggattgtattgaaagagattcaggcatatacagcactttttatagactatcagatgattatggaagaactttgtgagatgcaagttagttacgatcaggtaatcggttatgatacacagattagtaagttgcaggaagaatataaccgttattacagtctgaaagcatctttgggtgatgacttgaaagagggactgatcagcaaagcggagttcgatgattttcgggaaagttatggaagaaaatgtgaagaactggagcagatgattgagaatcagaaaaagctgataaagcaaatgtttgagggtggagtgtctgcaaccgttcagttggaggactggaagaaatcactggaaatcaaagaattggatcgcacattgctggcactgaccgtagataaaatctatatttatgaaaacaagcaaattaaaattcacatccgctatcaggatatgattgagaagatgaaagtcataagacggttttatgcggaacacaggacagaatgcaggaaagaggtgggataaatggcaagaacagcaaaaagatataagaaaaacacagagaagaagattcctggtattccggtatgtatggctgcaatttatgccagattatccgtagacaatgatgaaaaaaagtcagaatctattgaaacacaggttacgctgataaaagaattcattcagaagcacaatgaaaatccggacaaagagtatgagattgctgtatatgatatttattctgatttgggaaaaaccggaacaaattttgacagaccgggatttgaacggatgatgaatgatgtcagggcaggtaaactaaactgtattctggtaaaggatttctcacgatttggaagaaattatatcgaaactggcaactatctggaaaagattcttccttttatgaaagtgcggtttatttctgtatgtgacaactatgattcatttgcaccggatgccaagaatcaggaattatccatgaatatcaagaatctggtgaatgatgcttatgcgaaagacatttccgcaaaagaacgggcagcgaaacgtattgcacagaaaaatggtgagtatgtgggatctacagctccatatggatattgtgtggaaaagataaatggaatttataagttgatggtggaaccggaagctgcaaagattgtccgcaggatttttgaagaatatgcttcgggagatggcatacagagcattattgacaggctgtttgaggatagggtacatcggatttcagattataaccaatatcatcatgtgtactgtcaggatggagagaaccttcatcagtgggggaattcttcgatacgtgcagtgctgaaccgaaataattattatggtgatctggttcagaggaaatacgaatccagatttcaaagaggggaaaaatggtgtgacatattggacgagagccagtggattattacaccaaatgcccatgaaccgattatcagccgagaactgtttgaaaaagcacaggtcaggctaaaagcagcacaacagaaagcaacaaaaactactgcagggtgggaagatgatgaaagagcattttacaatgtattctattgtggtgattgtaagcggaaaatgtgtacacgtagatacagaggcaatgtgtattacttttgcaatgctgcctggtatcgggatgaaagaaaatgtagtcacaaatctatttccgaagagaagttgcagaaaattgtccgttcggagctgaccagacagtttcagttatctggattgcggaaaaaggatatgtctgctataagcagtgcggtatttctttccaaaatcaatgagattcaaactgagatcagaaaactgaatatagatatggaaagacgttcagaaaaactggcacaggcatttatgaaatataaagagggtgaactttccaaagaagcctatatagaaatgaaagatgaccgtaatagctggaaagagttctgcgaagagagaaagaagtctttagagcagaccatacgaaagctggaaaaacagcagaaagaagaagccagatttttacgaagcctgctggagctggatgggacaaccagaatcaatgcggaacttgcagaaggcttgattgaaagtatgtatctatatggtgatggcaaactggaaatcaacttcgggtttaagggggtggtagaacatgagtgatcagaaactgattattggatattaccgcctttccatggaagatgactcagagggagaaagtaacagcattattaatcagagaaaactggtaaaagattatatttccaatattcctgaactggtggctatgccctttcaggagttctacgacgatggatattctggttccagtatggaacgtccggcaattaagcaggttctggaacttgccagggagaataaagtgcagtgtatcgtagtaaaagatttttcacgttttgccagaaactatattgagatgggaacttatctggaacagatttttccattcctgggagtacgatttatttctatttcagaccgatatgattctaaagattataaaggaaagagttcagacatcgaagtacagtttaaaggattgatcgcagacttctatgtgaaagatcagtctgtaaaggtaaaggcagcagtcagcaccagacggggaaaaggtgagtattgttgtggttctgcaccttatgggtatcgaatcaatccagaaaataagaaagaactggtgattgtagaggacgaagcggaagtgattcgcagagtatttgaactgaccaatcagcgatattccaagatggagatttgtaagttattcaatgaagagggtgtattgactcccttgcagtctatgagcagacgacagaaatcagacagcaagaaagctgcatcaagaggattgcagtggacgagtgatatgatacggaagattgtggatgataagacctatataggctgtatggtctatggaaagacaaagattccagatcccggaacagggaaagaagtaccagtgccgagaaatcagtggaaagtgatggaaaatcaccatgagccgatcgtatcaaaagaagtttttgaaaaagcacagtccctgcagatcagatacaccaagaaaagcaaattcgacagggaaacaacactgttaggtggctatgtgaagtgtggaaattgtcgcagaagcttgacttcaagcagtccggttcatggtcatatcctttatagctgtgcttacagtaaaggaaaagaagatacaggatgttttgccgggaaagcggataacaaaatgctggagtatatcgtgctggcagaaataaaggcttacttacgtcagaatatcagccaagaacagatgcagcaatctatgagaaaacagcatgaggacagtatagaagcctgtaagacggaaagtgcagactgcgaaaaacgtcaggagcagataaagattcagaaccgacagaactatgagaagtatcacgagggacagatgaaccagaaacagttcatggaagcaaagatgcagctggaagaagaaaaagaacgactgcagaagcgtgtgcaggagttggctgagttgataaacgctgagaaagacatcctgatgaaaaaaaatgttccggtggagcagatgttgaagtatttaggctatgagaagctaacacgagaaatgctggaagaatatgtgtccggaatatatgtgtatgatgatgggagagtggaggtagagtggggatgaaaaaatactagttatgtttattttaagaagccttgagtgattgatttttaaaggcgggattgttataattgtttctataaaaagtgcaaaagagagattgaaaagggtgaaatgtaacaatggataggatattgatatttgatcataatattaaagatataggattgtatacacgaccatcaactcaaggggatgagttggatttggttgaagattttattgaatattatattcataattttttaaaaagcaataaaacaaacaatttagctatatttgtagaacctaaagttgcatccggatttcctgacattgtatttgcatcatattcacctaaaatattggagaattggtctgaacaaagagaaaatctggaaacgaatgatttaaaagtgttatctcagttattgatgactaaaggaagtacaggaagtgaattgataacaagacttaagatgccagaaaaagatacaattcaggccatagaaaaattactagatgcacatatgattatacgtgatcacggcttatggaaaccagtagacatcaaaaagatatataatataaaaaaattgatttcagtggaagctaaaatgacggatataaagaaagttgctgaacagtctcttattaatacatggtttgcatcacaatcatatgcattaacaagtacttcaaatccgcaaagtagtacgattaaaaagtttgaaagacaaggcacaggtttgtattgtaagaagagaagttttagaaaaatagtagaagcaaagaaattagcatcaccgtcaagttatcagtctttacagtttaatgaatggattggaaggactgttgcccatttaagttaggagaaatgagagatgaaaaaatttcaagaaatgtgtcaagaagaatttgaaaaaattgaattgatggcacgtggtggacagaagattgtatttgatggagttcacaactcatatggagaaactgttattaaattatattttcagcttaacgatcccaggtctcttagggaaatacaaatagaaagagatttaaacttatccatggtacctaaaatatatgaaactggaaccatagagtatgagggaacagagacattatatattattgagcaaaaagtaaaaggaacagaattacggaaggtgcttgaaagtggcaagagattttctttagaggaagcagtgacatttttggaacaggggttagagtttattgcttgtatagagaataaaggtattgtgcatagagatattaaaccggaaaatattatacgagcagatgatggtagaatatttttcctggattttggaattgcaaggatattgggagcagattcattgacaagaacaggtgcaatgatgggtccgcatacacctggatatgctgcgcctgagcaatttaataatttaaaaaaggaaattgattctcgagcagatattttttcactaggagttgttacctatgaatgtattacaggaaaaaatccatttagagaaggctctataaatgcacttgaagtcttacaaaagacagaaactattacacctgtacagtattcaatcaaaggggatactcaaagtcagtttatggcattattaggggcaatgatgggaaaatatccttctagaagacctaggactgctaagcaagcaatagattggttaaaagtagctaaaaagacatttgtttatgaatagaaggggttaaagaatggaactttttatacaaatgggacataatatgcaagcgttagctctcgagcatttagaagagtttgatggtggaactattatcattagccctatgaacattttgcccaataaggtaaaaggttatgcaactagggtgcataagaaaaaagggaaagtacttgttgatccacaattgtattatcctagacaatatcaaaaaaaaatgtctcagtatgcatattggccgaagagtgatattacatcattggaaatgggacaatttgatacggtagtagaagaactatcaaaattaaataacgaagttgaggcagaagcgtttttgttgccttccattactgctaagaaaatagacgatttatggaataaaatacagaaaataataatagaaagtgcaaaaaaatatgcacctgatatgaagtatatacacacaatttcattgagtagtgatgtacttaatgatgaaagccagattgaacgggtgatagagtatgttgaagaatgggatgtagaaggtgtatatattgtatgcgaacatccggaacgatattatttggtggatcgaccattgtgggtgtctaatattatgtcattagtagcaggaattaagagacagcggaagatgacgattgtgggttatgcaagtcatcaattattatgtatggcattagcaaaatgtgatgcaattgcatcagggaattttttgaatttaagatggtttcagccagaacattttgaaacaatagatgataaacagcctagccgtcgagcggtatggtattattgtccacaagcattatcagagtataaaattccttttttagacattgcaaaacgtatggacctattagatagaattgaacctccagtaacgatgaaaaataaatatagtgaaatgttgttcaatggaagtttaccatcatcaacaggttttggcgaaaaagaagcatttaggcattatctttattgtcttcataaacaatgtcaaaatagtgttctggaaacctatgctgaaacaaaaaatttacatgttttaatgttggaaacagctgaacaattattatcggggttaggaaaaaaaggaattaaagggcaagatcgagattttactgaaattttggatgtaaatagagcagctatttcagctttcgatatggcttatcattttccgctttcacaagaatggaatgagttataaaaaatcgttatgcggagaatgatatttgtagcaatgacataacatcctccccaccaactttgtgacaattatataacgtcctctatacagaaatatgcggttttaagccattttcgtggtaaaaaagccgtatattttttgtagcaatgacttgacatcctcgggaactttatgtacagcacaaagtatcccttatatgtgaaagtaaatgttgggtaaagagtgaagattttcattcatccgggtttgtttcattcattgcggaatcaatatacatgcacaataccccggatgcggctgagagcaataaatagtcaggtctttcccgatttccggactgtaaataaaatatatgcagaaccatcaaatcaaaaagagtggggcatgtatatgactggtgatatatttttcagctacagcaaagtgtacaaaaacaaatagacaaaaatatgaaatatgtctaatttgttcctcgattttctatgagaaaaagagtaaaacataggtaaatcaaaaaagagagaaatgcattgcttaggacaggtcacaagaagtaaccggattacagagagccgcagatgatgagacacggcagaaggtattttgtgatatcaccagggagcatcccactaaatattaaagtaagccgggacgtagtcttcacgttacagaagaagctgtttatactgacagtagtaagaggttatatcagatgtgagatgactcccacctctgtaggtggtgagcaacaaaattatatcagtggtgggattcaatctcccatctgatatagcctccggcaggattgcagagatgcacagaagaatatgtcatgcattgcatgacgtgcatctcgcagcaagaatgccgagggcattcttgaattagtaatagataggacaacgcaaagtggtaccgcggaaatttcgcctttgttatccaaatggatagcagaggcgttttttatatacaaaatataagagaaagaagaggacaagattatgagtggaatcttaatgatggtaatagccattgtagtgtgcaaattctgctcgaacggtacgcctattctgaaattagcggtacatccattcttgccaggactgccaaaagtaccggctgcagagagaattgatgtagacgagaccggaaagattactggacttttctaagaataaagtctcatattaaaaaggtatagtttttaccttataaggcagggtaaattcaatttggcaattgagaaaaccatttgcgaggggagggcgctcacagttgcgaaggccgctctcccctcgcgcaccccaccgggccacgctgaaaagaattgtggtaatatataattatatcattagaatgtaaaataacaggatatcttctccatacgagagagaagagtcctgttatttttatatactgctatattatttataagaaagtcttccgctttgaaacaccaggaggatttttcaaagggaaccacataaggcaaaatttccgtcaaatattttggcccaggggttgccaggggactggctaagtcccatggcggttttcttatattccaatatagaaaaaggtttcaggaaagtattcctgagaaagaaatgttaatgcaaattaacgggttcaagggaagtccccttgcgggtcagagggcagttccctcatgtacgaatcggttgatataatgcagtgccgcgccaatagccggagtatattgtccatgtgtgccgaccagcagttgatcagctgtgagagtgaatggggtattttcattgatcagatgcagtagcatattgagatcttccggaaccaggtaaggggcaagatatccgctgataatgatagggctgtcgatgatcatattcagatttcgcatcgcaaatgcaagatgtttaagataatcctgccagattgcattcagattttggcttactgtagaaagtcccatctgcagatcctgcacgatctgcaatttggaagttattttagtataccataataaaatacggcaaaaagaggaggagcggatagtttaacgccggtcattgacaaatagttgtattctgtttaccatggacaacagatacagagatttatccagtagatattcaaataaaatgtggataaacatttgaacggggaggcctgaaaatgaagataacagagcgattgaatgctcttcgagagttaatgaaagaaaaaaagatagatgcctatctggtgccaacggatgattttcatggatctgaatatgtgggtgattactttaaatgtagaaaatatatcacaggttttacaggatcagcgggaacagctgtgatcatgcaggatatggcgggattgtggacggatggtcgatattttatacaggcggcagatcagctttgtggcagtacgattgaactgttcagatcgggcgagcctggggtaccgacggtacatcagtttctggcagaaaagctgcaaaatgctatgtgtctggggtttgatggaaggactgtcagtgcagaagaagcggaacaattaggtgaacttttgaaagaaaaaaatatcacatttgctgtaaatgaggatctgattggagaaatctggagtgaacggccggcactttcctgcgagccggtcatggaactggatgtgaaatgggctggcgaatcaagaaaggataaaattgcagggattcgagagcagatgaaggaaaaaaaagcggatatttttatccttacttcgcttgatgatattgcctggctattaaacattcgtggtaatgatattcattgctgtccggttgttctttcttatttgatcatgacagataccgaggttcgattatatgcaaacgcagctgctttttcggaagaaatctgtacaaatctggcagatgatggagtaaaaatctatccgtatgaggatgtttattcttatgttcagataatctcagaggataaaaaaatcctgctttccaaagccaatgtcaacagccgtctggtaagtaatattccatgtaatgtgacgattgtggatgagccgaatctgacacttcttccgaaggcagtcaaaaatcagacagagatggacaacgaaagaactgcacatatcaaagatggtgttgcagttacaaaattcattcgctggatgaaaacaaatgtggcaaaagagaggattacagaactcggcgcagcagagaaattatatcagtttcgcagtgagcaggagcattttattggagatagttttgatccgatcattgcctatggaaagcatgcggcaattgttcattacagtgcaacagaggagacagatattccattagaggccagagggatggtacttgcagatactggcggacactatctggaaggtacgaccgatatcacaagaacgatcgtattgggaccggtcacagagaaagagaagaaatattttactgcagttctgcgtggaaatctgaatctcgcagctgcgaaatttaaatacggatgcaccggattaaaccttgattaccttgccagaggtccgctttgggaacttggcgaagattataatcatggtaccggacatggggtaggatatcttctgaatgtgcatgaagggcctaacagtttccgatggaaaaatcttccgggaaatccggcaccggtgttggaagaaggtatgattacatccgatgaaccaggatattatctggagaatgaatttggcatccgtcatgaaaatcttgttttatgtaagaaggcagaaaaaactcctttcgggcagtttatgtgttttgagtcactgactatggtaccgtttgacctggatggagttgatacggaacagatgtcggaccgtgaacgaaaactgctgaacgaatatcacaaaaaagtctatgttaccatagcaccatatctagatgaggaagaaaaagaatggctgagacaggcaaccagagaaatctgacaaagggtgaaaaaacaaaatatcgactggcgagagcaatgaaagaatgcatgaaaacgacgtccgtagagaatattacagtcaaacagatcacagagaaatgtgaacttaccagacagacgttttacaggaattttctggataaatatgatctgatcaactggtattttgataagctgctggcaaagtcttttgagcatatgggtcagggaaaaaccgtctatgatgcactggtcaaaaaatttacttatatacaggaggaacagaaattcttttcagtagcatttcgttatgatgagcagaattctctgcgacagcatgattttgagttgattctggctttttatgaaaatctgatttgtgaaaaaactggcaaatttccagaggaaaatgttctatttcttctggaaatgtactgtaacagttctatttacatgactgtcaaatgggtgacaggggaggtgacatgtacgccggaagagcttgcagaaagacttgtggacggtatgccggggaaacttgcagaagtatttacaggtcttggaattctgaattgataagtgctaaaatgctggaaataaaggaaatatggactatatatgttttccgcctaaaaatcatctggtgatttttactgaatatgaatatcaaaaattggaacaaattacgaaagttacagaaaacgttacacatgacgaattctgtaactttcttttttattaaaatattgttaatataataacaatttggaagaaaaaactgtgaggaattgataaaaagatactcacgatcaatgcagaaagggatgtatttatcatggcaaacagaattaatttaaatggaacgtcttaccacggagcaggagcaattgctgagatcgcaaatgaagcaaaagcacatgcattcaaaaaagcttttgtatgttctgacccggatctgatcaaattcaatgtgacaagcaaagtaacagatgtccttgaaaaagaaggtctggaatatgaaatttattctgatatcaaagcaaatccaacgatccagaatgtacagcatggtgtagaagcgttcaagaaatccggagcagattatattatcgcaattggtggtggttcttctatggacaccgcgaaagcaatcggtatcatcatcgcaaatccggaatttgaagatgtaagaagtctggaaggtacagcaccgacaaagaaaccttgtgtgccgatcattgcagttccgacaacagcaggtacagcagcagaagtaacaattaactacgttattacagatgtagaaaagaaacgtaaatttgtatgtgttgacccgcatgacatgccgatcattgcagttgtagatccggaaatgatgtcttctatgcctaagggactgactgcttctacaggtatggatgccctgactcatgcaattgaaggatatactacaaaagctgcatgggaaatgacagatatgttccatctgaaagcaatcgaactgatctccaattctcttcgtggagctgttgcaaataccaaagaaggtcgtgagggaatggctcttggacagtatatcgcaggcatgggcttctcaaatgtaggtcttggaattgcacactccatggcacatactctgggcgctgtttatgatacaccacatggtgttgcctgcgcgatgatgcttccgatcgtaatggaatacaaccaggaatgcactggtgaaaaatatcgtgaaatcgcccgtgcaatgggtgtaaaagatgtagattccatgacacaggaagagtacagaaaagctgcaatcgatgcagtaagaaaactttctgttgatgttggaattccgacaaaactggaagcaatcaaagaagaagatctgcagttcctggctgaatctgcacatgcagatgcctgtgcaccaggtaacccgaaagatgcaagtgtggaagatctgaaggatcttttcagaaagattatgtgatttagaaaaattatataaaactgcaaagggactttgccagtccctctgtacaccctgggcagggtgtaaataggaagtttagttgtatgaggaatcctttgaaaatttctcctggtgtttcatgaggagagtttttcgtaaaagggttcctctttttttggtaatcccctgaattcaggcattcttatgggctgggttttctcgaagtatgtcatactatggctgggaaggtcagaaatggagtgacctgcttgaccagtatgcaaaatatcaaaaaacattacactttgagtaaaaaaatataaaattgattattcataaatgacagatttgcaacggattacagtggagtatgattgcgagaggataacaatagagaatgtgcaaaataaaaagatagtattttactttttgtgcggaaacaggtattatataggtaaaacgttactgtgtatttgtaaagtgacagagtaacaataacaggaagattttctgtgtacagacaaagattttcacacaaggaggaagattatcatgaaaattggttttatcggttgtggaaatatggcaacagccatgttaaagggaattctgaaaagtggagaagtggcagcgacagatatgatcgcttctgcaaaatcagataagacacgtaaaaagatcgagcaggaacttggcattcagaaggcagatactaacgcacaggttgtggattttgcggatgtagtttttctggcagtgaagccacagtttctggaaggtgttctgaatgaaattaaagacagtgtaaaagaggaacagatttttatctctattgcaccgggtaaaacattacagtggcttggggaacatctgggagaaaaaacaaaagttatccgtactatgccaaatactccggcaatggttggtgagggaatgacagcgctttgtgtaaatgagctggtcacagaaaaagaaactgcacttgccgtaaaactttgcaataccttcggaaagacagaagtgattccggaacatctgatggatgcggttgtaggtgtttccggaagctctccggcatatgtgtttatgtttcttgaagcaatggcagatgcagcagttgcagacggaatgccgagagcacaggcatacaaatttgcggcacagtccgtgctcggaagtgcaaaactgatgcttgagacaggcaaacatccgggtgaactcaaagatatggtctgctctccggcaggaacgacaattcaggcagtgcgtgttctggaagaaaaaggtctgcgcagtgcagtgatcgaggctcagactgcatgtgtgaaaaaagcaaaaggaatgtaaaataaaatttaaattgacaggcagacactcatcaatgcacagaagtatccggatgatactgataggatcgctgggcgtgtttttttataattattttttgcttcttgggacagcacgtctcaaagcacagacagcatttgtgataaatgaactctggccagcgctgatcattcttttttcctgctggatcctgaaagaaaagatgaatctgggaaatacagcggtgattgccaatctggcatatctgattccgtttgtgtcgctgattctgacacattttgttctgggagaaaagattaccgtgttttctgttctgggtctggtactgatcgtgacaggcattattatacagatgatagtaaataaaaaatggaggcatcagagatatgatatatacggtgacgtttaatccttctctggattatatagtaggcgttgatgaatttaaaacaggaaaagtaaacagaacagcagaggaacttattttgcccggaggaaagggaatcaatgtgtcaatcgtacttcaaaacctgggaatggaaagtatcccacttggttttgccggcgggtttacaggagaagagattcgcagactgatgaaagagcggaagatagaagagcagtttgtgcgggtaaagaaaggaatctcaagaatcaatgtaaaattgcgttctctgcaggtgggagagaatggtgaaaaaactgtatcagaggaatctgaaataaatggtatgggaccggaaatcagtggagaagaactggaaattttttatcagcagctagatgctctgcaaaaaggggacatccttgttcttgccggaagcattccgacggttcttccatctacgatctaccgtgatattatgaaacgtttgcagaagcgagaagttatgatcgttgtggatgcaaccaaaaatctgctggtaaatgtactggagtatcatccgtttctgatcaagccaaataattatgagcttggagaaatttttggtgttacgttgagcacaaaagaagacgttattctttatgcaaaaaaactgcaggaaatgggcgctgcaaatgtactggtctctatggcgggagatggggcagttcttgtggcggaagatggatccacttacaaaagtgaagcaccggaaggtaaggtaaagaattctgttggtgcaggagattccatggtagccggatttttatatggatatttgaagtctggtatatatgaagatgctttttattatggagtctgtactggaagtgcaagtgctttttcagagaatcttgcaacacgagaagaagtggatacactgttgaggaatataaaaaacagagcataaattaattcaagtcgaacaaaaaaagaaatctccgtgtatgaaaagggaaagagaggattcatgcacggagattcttttatcgaaaatcagaagtatccgatgaagccttcttctacgagttcatgtaaacggtcgatcgggaacatggcgttgacatctttattgatatcggagttgtcgaagtcgccgtgtgtaaccatcagcatatcagaaggagtatcaaaaggaatgactctgtaggaaaaatcaccggatgtattgaatggtgtctgatctttgcggtggataccacctgcagtgataaaagctactttacattcacttaaaggtttctttaattctgtaaatatcggtttgagtgtgatcggtacaaaaatttctgactgcatgccttctactgtagttaatttcataataagttcctcctcttaaatggattctaccggaatatcttttttaccaatgactttcatacagctgaaatagaattcagctgccagaccttcctcgagggtgactggattgatgagcctacatctgcacttgccccagagcttgtaggtgaagtattaaatgttatgaaagatctggcaaagtcaggaatgacaatgatcgtggtcactcatgagatgggatttgcacgtgatgtggcggacagagtaatttttatggcagatggttatgtggttgaggaaggaaaaccggaggaaatgtttacaaatcctaagaatgacagaacaaaagcatttttttcaagaattctgaacagttagggatgaggtgagctgttatggcagagacatcgtggaggcaacatcaaaaaaaatgaaccttcctgtctcaaaaatcagtgaacatgaagaaacatacagcaccagtcttttttccatgttgcttccattaggctctgattcgatagcaaagcaggatgaaatctacaatgtgcagaaagaggttatccgtgagatggcagaaaaggagtcgtgcattattgtaggaagatgtgcagattatatttttcgtgatcacagaaatgttttgaatatatatatctatgcgccggtggatgcacgctataaaaattgtgtggaagtgctcaaaatgaagccggaggaagcaacaaaaatgatctacaaagtagacaaagcacgtacagcatatcataagcgatatgcgaaatatgcaccaggtgatctggacagcaagcagatcatgatcgattccagcatgctgggagttaagggaacggcagaagtgctggcagagatcgtacagcggagatttggactatagatattaactgaaatgagaataaaatgaataagtgtaagacaagaaatagttataattccggagtggggttataactatttttatgttaatatttatttacacgtgcgtcctttttggcgtttttggcgtctaataagtagaagcacataaacagaagcttttacacaacatttcctgatgaccggtcagaaacaggagaatggagaaatcaatgaacaatgaatttttgatacgaagggcgaagaaagacgacaaagatgccttctgcagactgatggatgagcatttgcagtgtatgtacaagatggcatctgcatatctcaagaatgatgaagatgttgccgatgcaatccaggataccattctttcctgctatgaaaatctgagaagtctgaagcagaacagatacttcaagacctggatgctgcggattctgatcaataaatgcaaggatattctgaagcagaagaaacaggtcacctacacggatcagatgccggagactcctttttatgaggaagaatatgctgcaaaagaatgggcacagatgctggaaccgctggataataaatatcgtctggtgatccttctgtactatatggaaggctttaatatccgggaaatcagtgacattctggatatgaaagaaagcactgtgaaatcgcgtcttcagagaggcagaaaacaggttgcagaattgtatgaatataaggtcagggagggacgtgcctaatgatgagtcttaatgataatgaaaaggattttcagaaaaaacttcaggaagaaacagaaataccgctgattgtacatgagcgcgtgaatcaggcatatcgtctgattgaaaataacactgctgtgcagaaaaaggcgccaaaagaaccttatcactggatgaagctcggaggaagaattgcaggaggtatggcagcagcgcttgcagtcggatttatattctgtgcagtgaatccggttatggcaaaaaatcttccagtggttggaggactttttgaaatgctgcaagataacgtgagcttctttggtgattttgcggatcatgcaacgactctggaagctgttgatacaactgagacagaaggaaccgcggcagacactgggtcagacacagaaggaaatccatcggaagatactgaggcgggacaggatacgaaaaaagatgacaccgcatataccaagacagcagatggtctgactatcacatgctcggaagtatacgcgaacagtcaggcggtctatgtaaccatgcagtttaagagcgagcagccatttccgaagacagaaacttttgcagaaagtggaacaccagttattgatctggatatgactggtggtgtggattttaacgcagaggcggatccggtcatcgatggtcaggtggaaggaaagtttctggatgacaacacctatgcatgtattttccgttatgatcttgcacatgcggcaaaagattacaccgaatataatgagaaatacaatgaaatgacgcagcaggtgctggatgaaatgggaataacactggatgagctggatgatgagacagatgaaggatatgcgttgctggaagaatatatcaataaagtgtctgagcgtggtggagcatatcagaaatatattaaagatattgagattccggatacctttaacctgcatctggatatcacgaaggtaagaggattggaagcagactatgagtggtcagaagcggatgaagaaaaatatggaacagatgcgggctactacaaatatgaaggtgactggaactttgatattccggttacagtagacgattctcagactgaggttctggaattgaacgatacaaatgaggcaggtatcggcctcagatccgtaatccgtacaccatatgagctgacggtaaatgagctttatgaggatggctctgacagtgactgttttatggttgctcttgatgccaacggaaacaaacttccatataatgattcggctggaaactgcaataattttacaatccaggacagagatatttccacggttgacatctacattctggactatactcagtacatggatgaactgaagggaccagataattacaacaataatgaaaacaaaccagagggtcagaagtggagtgatcttcttgaccagtatgcaaaatatcataagactctgcattttgactgataatagtatagaatgaaagaaataaaaagatagtatttcttgcaataaaacactgagatacctttggtaagacagaagttttgtttggtcaaccattatttctacaaacgtagaattagtggttgactttttatttctacagatgtagaatacaaataacttctacaaatgtagaaaataaaaatcagggagaatccattatgaaaacaaaaacaacaaaatttatgacacttatgaccgtatcagcactggggattttttcggctggaactgttatggcagacggaaataatgatttctatacacagccgccggctggttctgcctgggagaaggcagatacggaaggtacttatgccagctatacgaatggaagtgattatgtaaatatttataaatattcactggatgatgtaaaaaccgggatagccaaatgtaacgatacatatgaggcctgctaccagacaatttattcagagggaaacagtctgtatatggcagtaggatatgtaaaagatgcagatgatatcggtgacgtcagaaaatttgtagagtatatttcttatccgggaaatccgtctcttacgagagaggctgacgaaaattctgataaatcagagcccggtacttctggccagaagtctgggggagagacaaattcctctgattctgatacagaaaaaaacgcttctgtcagttcatcagacagcagtgatgattcagatatccgtactacttcaccgatgacattagttgacagtgatggaaatacaattgagatcaattatattcttcacaaggattattcctgtgaatatcgtggagatgacggaatggaatatacggataacggggatgaaacttatacagatgaaaatggaaatacgtatacagctctgaatgatgacacacatcatctgggacatacgctggaacagcatgatcttcaggatgcggacggcaatacagtgacagttacggaaactacaaatggtgattattatttccgtgacgacaatggcaccggatttacagacaacggagacggaacatggagcgatgaaaatggcagcagctataccgaaatgaattgataggtaactgttcacaggtaatattccgcgaggtgttttgccatgaatatggcaaaatcccgagacatacggggcaaaatcctatcaccgaaggtgatctggaatggattttgaccaagttgctgtgaacggagtgaacagtaacattgatagcgacgagcttctgtaaaatgtgcagaagctcttgccatttttgggccccgtggtaaaataaaattattcctacatttgtaggaaatatatcagatgtgaatcaggagggtggaaaagagtgaaaaaaacatatcagagattacctgaatcagaattggatatcatgcttgttctttggaacggaactcctccgatgaccaggtcggaaattgaaaaagtaatcaatacaaagaaaaaacttgcatcgacaacaatcctttcactgctgacaagactggagagtaaaaattttgtggaagtgacgaaacagggaaaattaaacctgtatactccattggtttcgcagtcagattatcaggcacatgagagtcagagtgttcttgagaaactctatggaaattcattaaaaaaatttgtcacctcactttatcaggggaaaaaaatcagctctgaagaaattcatgaactcagcgattttcttaaggagctggaagacggggaggaatagcaaattatggagatttttgttctgcatattctgaaattgaatattattgcagcagttataattttactggtcaaactgcttgcgattctgtttaaaggtcaggtatcagcgagatggaagtatattatctggctgctgattacggtaagtctttgtattcctgtgcgccttccggcaaattttacgctggtggattttaaagtacagagaagcattcaacagaatgaacaaaattcgaagacaacggattacgcagcaagaccgggagagagacagcagaaaatggaaataatgtcttctgtgaacaataatacgaaaagtcagtctgaagttccggaacaaaaagagtttatcgtgcatacggctggaaaatggctggaaactattgctgtaatttttgcatcggtctggctgagtgtggcagtgcttaaactggcaggagaactgctggcatattacctttccatgaaaaatctcaggagaatgagccttccagtcaatgattcggtgagtattcagatgtatagagatgtatgccggaaaaagagtgtgcgcagagcaccggagctcagacagaatgcgggtcttactacaccacttctggcaggactcttccatacaaagttgtatcttccggcaacaggctattccgcagaggagcgaaaactggtattttaccatgaacttacacattattgtcatcgggatctctggtataagatgcttcttcgaatctgtgcaacaatatactggtttaatccgtttcttcttattatgctgaaagaagcagataaggatatcgagaatctgtgtgatacggcagtgattaaccgtgtaaacaaaaaagaccacaggctttacagacagctgcttcttcgtacagtggcgatgaataatcagatcccatatgtaacagcaagtctcaatgacagcggaatggtgtttaaggacagaattttgtatatggtgaacatacggaagcttcgtagaggaatcctgccgggaattcttgtgacggtgcttcttgcgggcagtaacctcgtatttaatgtttcggccgggacagatacagccccaacgcgaacagagagaacagggcaggaaaaaaatacagatccggaagaaaagaatgcaccggattatgcaccattttctgaaatgatagatatgcagaaaatagcagggacacagagtgaaacgggagtgtcagaggatacaaatacagaagcttctgtaaattcgggagaaaacatcagtgcggaaacaaattctgattctactgtggaaagcaacgagcaggaaagtgaaacgacagataatggaagtggttctgacagcgatgggtcaggatcctattatgagagtcttccggcaggagtgccatacaccagtggcttcagtactccttccggtgtggcatcgattgtagcatcaggtgaaggtgatgaggaatccagagtcctttacgacaacggagatggaacttattctgactataacggatttcaatacagctatcagggagacggaaactgggcagatgccaatggaaattcttatcgtacctggaatgacgaagactacaatttgggaacgaagctgggacagcatgaactccagggcagcggcggaagtgtcgatgtaaaagagaccacaaacggagattattattattgtgatgcaaatggtgttggctataccgataacggcgatggcacctggaccgatgagaatgggaatagttatacggagtaaagtctgctatgcatgataaaaagatagtattttacttttgaggtggaaacgggtatcatatgggtaacaactttttcacccaagaaggaggattatcatgagcaaagtagtagatattactggagtttcttcaaaggaagccagattgaaaagaattatagcttctctggaagaaataaaagatactcttgtggatgtgattgatgcatatgaagcagaagatgagagcagtgacaaactggatcttctgacagaggcactggatgcactggaggatgcgaatgacgcactgaatgatgcatccgatgaagcctgacacggagagaaaaatatggcatcagaaagagcagacgagctttacagagcattgattgaaagaagatatccgaaggaactatgttcagaaattgcctacaagtatctgaatacggattacacagcaacgcgcatgctggggtatctgtacaggatgacagagccacccgcagttgaggtagtggtggatgaaatgattgcaattttgagtgacagggagcagcttataaaggaaaaagaatcagaacatgcccaggctgtgatcagtgagatatacagggaagggctgtagatatataatcggatcccttttacacacaataaaaagagtgcagatcctgacaattcagtacaggatttacactcttttgtgttatggaagagttgggtaaatggatgatatacccttgcagtatattaacgtttacgcagacgaagtacatacaggatcacacctgcgacgatcataattggaattaagacacttaagactgtgcacagaaggatgatcacaacagctgcaatcagtatgacagccagtttgccgtaccatgtcgtcagatccagatggaagctgtgctgttttacctttccatgtccggaatcgaaattttcgtatccgttatatccggaagaatggccgttatatgattcggaataatattccgtagtctgaggatttcctgatgcggcagcttctgtgtccagaagtgtacgtgcgatcagatgaggatcgccgagttcatttaaaatatcgtcttcactgcgtcctttacgctgttcttcttcaatataattgcgataatattgtacatgggcggcaacatttccctccggcatctgcccggaaagctgttcatataaaatgtcaagaaattcttttttgttcataacaaatctccataaaagcaaattcattgcctctgacagaggcttaattatcagaatggcaacattttaccacacataatgagaaaggaatagagattgaaatattaaattttcataaaagacggggtacaaagtcggataaaaaaaccaacttaattcataagaaattgcatttacctgaaaaacatgcctgtttgaatataaaaaagagtgcagatcctgacaattcagtacaggatttacactcttttttactacaacatttcccggtattgttccggggtcatgccggttttctttttaaatatccggaaaaaatatttcggattatcatatccgaccgctttggagatctggtacatcttacggttggaatcttttaataattctttggatttttctatccggacttcgttcagataatcaataaacttcattcctgtcttctgtttgaacagggtactcaggtagctccggttcagataaaaaagagaagcaataaaatcctgagtcagattttttggatagttgtgctgcatgtaagtctggattttttcaaccacatcatcaccggaataaatgctttcagccttcagaagctccgtgatattcataaaaaactggtagtaataatccttcagttccttcaaagaaaagatgtaattgaccacattctggatactgttggaggactttggtgtttcctgtttcaggtaataattcaggatattgcggcactgtccggaaagataatagcagtagtattttgcatctgcaagtgagaagtcagaagttctggccatcagatcaaaaagctgtccggtcagatcctgtacctcggcagtcattcctgcttccacacgaaaaagaaattcctcttcctgttcccatataaaggagcgaggttctgccgtctccatgtagtaaaagatgttttcggagtctccatttagtttctggcgattcagagcagcggatgtttcttcaaaagcttcgtgcagttcgctgagatcagagtgaggctggctgataccgatgatcagagaattctggagatgtcgtacatagtcagtaagagcagaggaaatctgatcgaccagtcgtctggaatgaattacttctgtattgggcataaaaagaaccaggaatcccatctgatcagatgcggtatttggaagataaagagcgaggtcaccaaaaccaccatcttccagccagtgctggatatctatattctgtatctgcgaagtagattcaaaatacagtgtgagcagcacaagctgatgcgtatcattgatgaaattcagtcgttttgaagagacagaaccttctccgacatgataaccaaggatcaggttggtcagatgctggatatcatagtcatagtaggctgcttctttttcttcatcactgtcggtgactcttgaaagggtctggctgtcttccaggcgtttgatcgcgcgggaaatgcagtcctggattgcctccttgctgaatggtttcagaatataatcgatggcagcagcagaaattgcctgtttgacatagtcaaagtcacggtaaccgctgatgacgatcagtggcatatctggataattttctgccagataaggaagcagttctttcccacccatgattggcatctgcatatccagaatcacaatgtccggatgcacttcctggatcagttcgattccggctttgccattatctgcttcgccgatacaggttatccggtcttccataggctgaagctttttaatggtgcctttacggatgagagattcatcgtctataacaatataagtatacatagctatcctcctgtcatttcagaataggaagtcggatctgcacattggtccattcattctgcctgctggtgacagtcaggccatagcctttgccataataaagttcgattcgactgtgaatgttttttagtccgatgctttgtttattgcggtgtccgagttcagtgaaagaagcctcttccatgagtgaactctggagttttgtaagtgtttcaatatccattccctgtccgttatcatatacatctatcatcagacagttgttttcagcataagctcggatgttgatggtatcaccagtggtgcagtaattcagtccgtgatataatgcattctcaaccagtggttggagtatcagtttcaaaaccttgttattcagatattccgctggaatatccaggtccagatggaaacgattgtcaaaacggattctctggatagtaacatagtcatttacgtggccgagttcatcctgaaccgtcacaagctcgctttgcgtcttcagggtatagcggaacatatttccaagtgcaagtgacatggtggcaatggtttcgttatcctccagttcagcaatactgttgattgcttccagtgtgttgaacaggaaatgggagttgatccttgcttccagcgatttcatctgtgcatccagaagaacaagcttgtcctgataatcctgtttgaccgctgcattcagcgattccaccatggcattatattcgttatacagcgtaccgatctcatctgtccgattcagataacgggtggactggatcagcgtatgtccggactgagaggacatcttatgacttaagtgttccactggatgtaccatataacgggagataatataagcaaaaataatataaccggtgatacataccgcacagatgattatgatcagaacagctgtgacattgaattcttttgccaggtttgtataatccatgaccatggtaagacgtagtggtgagagattgaggtctgtacgttgtacattgccgccatcgtttacaaaaccagagggcagttcattataattagtatataaaacatcattggtattggtattgtcaatagtaagtaaagtgacctccggcatggtgttgacggcgctcagatccagcatttgggaattacagtccagcatcaggactccgacgacctcatgagtgtagatgtctttcagacactgcgaaaaaaagattgtctgttttccacctgtaaagcagtcgtgaactgcgttgccgcttacataaagtgcaccatcaagatcaagtgtatcctgataccagtctgcattctgaaaatcataactggactggatcgttccgttttcatcatttgtacagtcaaaaatataaccggatggagtgaaaatatagatgccgtagatatcctgatcagaatacagaagattctgacaggtacgtttgaaagattgcgacatcttaaaatattcgtaagtgtccggtggtgagtcagaatctttgaattctttcagatcactgataatgctggtaccgtcgttgtaatagaaattaaacgtaccggcagtctggcgtatggtatctaaagtatcatttgcagcattccgggcattttcaaacagatgggatgagatcacatccatgcgttcataagtagtctgtgtgtaacgctggtaacagaaaacagtaaataaaagcagcggtacggtggccagaatactgaatgtgagaaagatttttgtgcgtagtttcatttttttacctcgaaaacaaaatctaaaaaaagtacaccattaaacccaacaaaagtgtaccatgactgtgctagaatgtaaacatcaaatgaaagacacgtgaatagtgtgaaaacatgaaagggaggattttaattatgaaattcaaaaaaatggcagcagttgctcttgcaggcgttacagcatgcgctaccgtaccggcagcagttccggtatttgcagcagagggctatgatcatgaagcaattgagaatgcaggagacatcacacttactatgatggtttccggtgttgcatctgacaatgattttgagacagaacagttaccaaaactggtaaaggaaaaatggccgaatgtaacacttgaggtaacaaagcttccggatgataactactatacctctctgaaaacaaaacttgcttccggtgaatgtccggatattattctgacacagccaatgtatgccggacagaactcctgctacgcactggcagaagctggatatcttgcttccttaaatgaccttgataatgtgcagggaagagaagatgctctttcttctgttacttatgacggagacattgtgacagatacatcaagcgttgctattcttggtacatactataataaagaattgtttgcacaggctggcattgagagcgaacctcagacatgggatgaattcctggaagactgcaagaagctgaaagatgccggaattcagccaatcgtaatgggcgacaaagatcagtatgttcttcagtttggcctgtatcagctggcagcagacgagatctactccaagaatcctgattttgatacacagttaagagacggagatgcaagcttcactgatgaaggcacatgggacaaggttcttgaaatgtacaagactctgtatgatgaaggctacattgatgcttccaaatctcttggatatggcgcttctcaggcaatccaggatttcattgacggaaaagcagctatgacttttgatggatctttcaacgcaacagctcttctggcagaaggtgcaggcggggactttgagagaggatacttcccgattcctggaacagatggtgtttacacagcaacatgccttggtgcaggatacagtatctacagcaaatctgagcatgtagatgaatgtaaagaacttcttgactactggctggatggtgaatcagagttatgggatgcgtatacttcaacaggaaaagttattgttacatatggtaatggtgcagatgctacaccgaactatgacctgttcaaaccattcattgaccttctgaatgatggtaaaggcttctactggagcaatcaggcatggccggcaggaacagagacagaaatggaatctctgttcagtgaaatggttggcggccagggaactgagattgaagatatcactgaaggaatgcaggataaattcgaggatcttctggacgaataacagggtttaaccataatagaaaaagatgaattatcactgccctggaacttaagacaagcttcagggcagttccatcttaaatggagggaaaaggaatggcacaaactaaaatgaagaaaaaaggtgcaaacacatctctggtatttaccaacaagatgtacttcttcctgataccggcacttgcatttttcctgatcttctggatctatccggtactgcagcttttttattacagtgtaacaaacttcaacggtgtcaattatgattttgatttcgttggaatgaaaaactatattaaggtattaaataatggtacgctgaccaactctatgaaaaacacgctggtttatgcagtgatcacagtcctgctcagtaatgtggttggtcttgctgttgcaatgattctcaatacaaagattcgtcttaagggtctgttccgtacctgtgcatattttccggcactgttcagtgctatcgtaatcggttttatctggtcttatgtttatatgccaggttctggtatgatcgcaagccttctgtccatgttcggactggatggtggtgcatttaacccgttgggaaactataagactgcactttatgcgattgcgatcgtggaagcatggaaagcctttggtacaacaatgatcatttatctggcaggtctgcagacggttgatgaaagtcttctggaagcaggacgtatcgatggatgtacagaatggcagctgttccgtaagatcaaactgccgctgatttcatcaaccgttacgatcaatattattctttctgtaatttccggtctgaaggcatttgactattctttcattatgacgaacggtggtcctggtaaatcaaccaagacactgatgttccaggtatatgagacagcctttacagatatgaagatgggacgtgcaagtgcattctcagtactcgcatttgcattcattatcgtaatcacagtatgtatgcttctttatatgaataagagggaggtggaattataatggcatttggaaagaaaaaagaatctcgcgaggttgaaggatatatgaaactgacaccaaagagtgcacttatctatctcgcgattattgttttctgtatcatcgtaatttcaccactggttattgtattttccagttcccttcgttcaccggggaatcaggcatccccactgatgcttttctcagaatttactctggcaagttacaaacaggcattcagcagcatgaactatccgatggaactgatcaacagtatcctgacaaccggcggttctgtgctctgcgtagtaatttttgctaccatggcagcatacccgatcggacgtattaaaaccaaaacagcaaaatttctgtattacttttttatttcaggtctgatcatcccatctcagatggttatcgttccgattgctcagactctgaacagactgggtattccgaatacccgttttacaccgatgatcatgtttattacctgttctcttccattctccgtattcctgttttcaggatttatgaaaggtgttccggttgagattgaagaatctgcatacatcgatggtgccagccttccgaagcgttttgcttccgtagtatttccgcttcttcagcctgcaattgtatcctgtgttatcacacagggactctggatctggaatgattatttctatccaatggtatttatttcaaagaaagcacagtattcccttccggtaggtatgcttcagttccttggtgacaaggaaaaccctgcccagtggaatatactgtttgcagcatgtgtactctgtgcactgcctctgatcattgtattccttgcactgcagaaacagtttgtcaacggaatcgcagcaggagcagttaaaggctgatgcctgatacagaattatatatgggtcggtattttatgccggcccattgattttataacgcaaaaaacaatctgcagataaaatgtaaaagtaaatgagaaaggaagtatttcagatggatgaaaaaaaagaaaagaagagtatgaagaataatctggagtacttctggatgtattataaactgccgtttatagcagggatgatagtcgtcattctggcaatgtattttttgattacaacactgaccacaaaagatacagcattatctgtaatgctgatcgactgtcacacggaaatgagcggtgaagagatggcagaggagtatatggatacagcggggatcgataagaaaaaatatcaggtacagatacagaacaacctgatgtttcagggtacagattcaggcagttattctatgacaagcctttctaaatttatggcagatatcggaagcgaacttctggatgtatgcggtatgctgaaggatgattttataaagtatgatggctcacagacctggacagatctgcgcaaatatctgacagacaagcagatggaagaactgaaagacagacttctgacagcggatgacggaagagtgatcggcattctggcagatgatcttcctgtcctgcaggcagaggaatgctatacgaataaagaaacagaagcggcaatcggtattatttataatgcaccgcacaaagacgaagcagtaaaatatctcctgtatcttgcaggagtcaaataacaggaggtataaagtaatgggaattttttcaccggatggtgcgctggcaaggcttttgaacacgcttggaaatctgatcgtactgaatattttgacgatcatctgttgtgtccctgtttttacagccggagcggcaatgacggcattgtatacgatggtaatgcggatggcacgtaaggaagacggaaagattatttcagaatatttcaaagcattcaaggttaattttaaacaggcaacgattctctggctgatttttggcgggctgattgcattcatgacatttgatatctggctccttcgttccattacaggaacttttggaatggtgtaccgtgtaatactttttgtgatcgtactggtttttgcgatgatactgatccatatttttgcagtgcaagcgcgttttgataatacaatgaaaaatacagcaaagaatgctctgctgttctgtgtgggcaagcttccacaggcagttctgatgctgatgctgacactgattccggcggtacttctgactatatcttatcgcttcgtttcggtggattttctgatcggattatccggacctgcatatctggcagcaatttattttgcggatctttttaagaattatgaagatgtagaggaggaaacagtgaaatgagaaccattaagacaagacattttactggaacaacagacaatacagtaaccaaaagagaactggataatcgtaaggttgtcagaagagcggcggcagaaggcatggttcttctgaaaaatgaaggacagcttctcccattgaaagaaggaacaaaggtagctctttatggagttggtgcgtccagaacgatcaaaggcggaactggttcgggtgacgtaaatgagcgcgagacagtcagtatctatcaggggatgaaaaatgccggctttgagatcacgacagaagactggatcaaagcttatgatgaacagtatcaggctgcaagatatgcgtggcgtgatgagattgaagaaaaagcttcccgtctggaagatcaggtgtcaggtttcttcaatgtgtattccaccacaccattcagaatgccggcaggagcaccagttactcagacagacgcagaaattgccatctatatcctgagtcgtgttgcaggagaaggtgcagaccgttttgatgcagaaggcgattattatctgacaaaagaagaaaaacagcagctttctgatatcggcagcatgtataagcatgtcattgttgccgtcaatacaggtggtctggcagatctttcctttatggatgaatattcaaatattgaagctcttctccagatcgtacagcctggtatggaagccggaaatgcttttgctgacatcatcagcggcagggtgactccgtccggtaaaatgactgacagctgggcattcaaatatgaagattatccgaacagtaaaaccttctctcataataatggaaatgtggataaagaatattacacagaaggtctgtatgtaggttatcgctattttgacagctttgatgttccggtaagatatggatttggttatggactttcctatacaacatttgaagcgaaagtactttcaacagtactcaaggacaataagattgttgtagagacagagacaatcaacacaggagatacatacagcggaaaagaagttgtgcagttgtatgctacctgtccggcaggaaaactggaaaaagaataccgccgccttgtggcttttgacaagacaggtcttcttgcaccgggacagagcgaaaaaatgactcttgagattgctttagataaacttacctcctacagtgaagcagaagctgcatgggttctggaaaaaggttcttatgtaatctggacaggaaatagtctggaaagttccacaccatgcgcagttcttgcactggatgcagatgtggttcttactaaaactcagaatatctgcccactgaaagaagagctggaagagatgaaacagtcttctgagaagatgacacagaaacttgctgcacttctgaaatttacagaagaaaaagcgcttccggttatggaattaaaagcagcagatgtggaaacacgagtggttgaatatcattccaacgcagaatgtgtaccggcagaagcgcgtgaatttgtggataccttaagcacagagaaactggtggcgctggcaagtggagatccgggcaagggacagggaagtaaccttggttcagcaggaatttctgtgccgggttcagcaggtgagacaaatgactgtgcactggaagacggaattccgggaattgttctgtctgacggaccagcaggccttcgtctgatgaaacattataatgtgtatgaaggcaagattgttaacaaaccatttaagttcagcctggaaggaggactcttctgtgaaggtgaaccggctgatccgggagaaaccaggtatcagtactgtactgcgattccggtaggaactcttcttgcacaaacctgggatactgcacttatcgaagaaattggtgagatgatcggtggtgagatggaagaattttctacaacattatggctggctccgggtatgaatatccatcgtaatccactctgcggacgtaactttgaatattattctgaagatccgcttgttgcaggaaaaattgcggcagccatgacaaatggtgtacagaaggtgccaggatgtggaacaaccataaagcattttgcatgtaataaccaggaagataaccgtatgggatctgacagtatcgtaagtgaaagaacacttcgcgaaatttatctgaaaggatttgaaattgcgatcacagaatcccagccaatgtctattatgaccagctacaatctgatcaatggtgttcatgcggcaaacaatgaagatacctgtacaaaggctgcaagatgcgaatggggattccagggcatgatcatgacagactggacaacgacagaacagggtgaagactgtacagcatccggatgcatgagagcaggaaatgatctggtaatgccaggagcattcagtgacagagataatctgaaccaggagcttgcagatggtactctttctatggatgaccttaaagcatgcatcagccgcctggtaaatattgtatggcagtccaatcagtttgagaatgcagttccgtataaaaaagtaaaataaaatcgaggcagactatgagcgagaagaaatttgaagtatatgatctgaaggttaatcagattacggaagcacttggcatggatgtagaaaaaccggtattttcctggaaattaagagctgaaaaacagaatactatgcagaaacaggcacagattctggttgaaaaaacagccggcagtgcaggggtctgggacagcggtgtaatggatactgatgaatccgcaggaattgcttacgcaggtgaagcactggaagcagagacaagatattacgtaacagtaaaagtatgggatcaggacggggaagaggcagagacctcttcctggttcgaaaccggacttatgaatggtagtatttctgcatgggacggtgcaaagtggattggtgctccggaattcaatgtggcatctgaaaagcttggtgtgtttgtactggaaagtacattccgcatcaaagaaggcacaaaagcaggtgttgtttttggagcaaatgatgcgcgtcttatggatatcagcaagaacgaactgcaggttgagggagagaacgatattcgttttgttctgaatattgcaaaatcaccggcggtgatcgaagtttacagaagaggatactgtaaagaagatgtggcagatactccgctgtatgaacttggaacaaaagatctgaagacagacagagaactgattacagaagaaaataagcatgattttcataaactgactatcgaagtagagggaaatggagtctatacgtatctggatgactgcgtagtggatgaggtatatgtcgatggaccttttggcggacagatgagaacaccgaggcagctgaatccgcttgggttatttgacgttacaacatttccgcgtctctgcgagatgggatattatgtaggtgctgacagtgaggcagaatatcagggaattcgtgtacggaatcttcgaaaaccatgcgcagagattcttgcggttgataccgaaaacggaaagactcttaaaggagaatgcctggagatttccaacccgagtcgtttttctctgccaatgcttcgtaccaactttacagtgaatggcaaagtggcaagtgcgagactgtatgcaactgcacgtggaatctatgaatgcagcatgaatggaaaacgtgtgacagaggaatattttgcaccgggtgcaagtcagtatgacaggcatctgatgtaccagacttatgatgtgacagagctggtgcaggaaggtgagaatggtctgggctgtattcttgcatccggatggtggagtgattcattcagtttccgtctgtacaattataactactggggcgacaggccatccttccttgggagactggtgatcacctatgaagacggacataaggaaacaattgttaccgatgacaatacctggcagtattttggtgagggaccatatcgatacgcaggatttttcaatggtgaaacatatgatgcccgactggaagaaaactattttaatttttcaaaatcggatttcaaggcagacggtctgaagaaacctgaagtcattacaccggttgtaatggaagaacaggaaggtatttttcctggcgcagcatgctggccggctatgaatgagaaggagccggagcttgtcggtagctatcaggcaccggttcatgaggtagaaacttttactgcaaaatccatgactgaaccgttaccaggcacttacatttatgatctggaacaggagattgcgggcgtaccggttctgaaattcaaaggaaaagccggacagaagatcacaatccgctacggagaagtactctatccggatctgccggaatataaaggtctggttggtcagatgctgcaggcgaacctgcgtgaggcttccaatgaagatacttattactgtaaaggcgaaggtatagaaatttacaaaccgcgcttcacattccatggattccgttacattgagatcagtggagttgatgaagcaccggctctggaggatgtgcaggcagttcttctttccagcgtggatcagatcaccggtaagttccattgtgataatgaactgatcaaccggtttacacagaatgttaaattcagccagtactgtaattttatcagcattccgaccgactgtccgcagagaaatgagcgtatgggttggatgggagatacacatattttctgtcgtactgcaacctatcagagcaacgtaaagaatttctatctgagaaatctgcaggcaatgaaagatatgcagacagaggacggaagactgcctagtattgctccggcaggcggtggattcggcggacagacttatgagagtgccatgatcctgattgtatgggaactgtatcagcagtatggtgatgcagctctgattgaggaatactacgattccatggatcattggatggacagcatgaaaacatttggacttccaggaacaccgtcacttcatataaatgaatggcttggtgactggctggcaccagttccggcagatgattatctgatctttaatgcattccactacagaaatgcagctcttatggagaagtttgcagtcctgaccggaaatgcagagggtcagaagaaatatcaccagattgcagaggaaacaaagagatattggaatgatacctttacagataaagagaccggtatcacaaagaatgcagatggaagtacctgtgatgtacagggaagctattctatcggattgaactgtgatgtatttgcagatgcagtgaaagaaaaggcttttgcacatctggaacgtaccacaagagaaggtaattatacaatccagtcaggattctttggaacaggaccgatcaatccgatgttaagcaaaggtggatatccggaagctgcacagaaaacaatcacccagactgctttcccaagctggctttatccggttacacagggagcaacgacaatctgggaaagatggaatagctttacacgtgagaacggatttggtggtaacaattccatgaacagctttaatcattattcgttgggaagtgtactaagctggctgtatgagaatacacttggcatccagagagatgaggagtatccaggttacaaacactttaccctgaaaccggagatgggaacttttgaatttgctgaaggtggaattgatactccttatggcagaattgaaagtgcatggaaaaagacagacgcaggatattcttacacctgtcatattccggaaaatacaacggcaacaattgttctcggaggagagcacaaagaaattggaagcggagaatacacattcactgtataacaaggggtctggagttcagtctcaaaaattgagagactggcttcagactttttgtatatgtttgatttttataaaaaaatatataaaagtatgacaaaaaagaaacttgtctgacaaaaatgaaactggtatagtatatagcaaatactttacatgatgttatgaggcaaaaggggtggagagatgttaaagatttttctggcagaagatgaggttgtagtccgtgagacgatcaaacgaatgatcccgtgggaggaacttggctttgagctggtaggagaagcggcagatggtgagatggcattgccgttgttgatcagacagcagccggatcttttgatcacggatatcaagatgccatttatggatggtctaacgctggcacgtctggccaaaaaggaaataccggggctgaaggttgtgatcttaagtggatatgatgactttaattatgcaaaacaggcgataggaattggggtggaggattatctcctgaaaccgatcacaaagaatgctttgattgaacggctttcagaaatccgcagccgctatgaacatgaaaaaacacagaaagaatattacgaaaaattccagagagagatgcaggcttatgagaagaacagcagccgcgatttttttgaggcattggtcggcggttccatggacatgatggaggtctataaaagagcagaaaagcttggtctggatattgttgcagaggcttacaatgttctgatctttacgatgaactgtgatgaggatttttccggacagagagatgaatattcttcgtgggaagcagagtcactggaacttctggaaaacttttttgccggtcattcatcggccatgctgtttcgaagtaatattttctcctatggtgtacttcttaagggacagagagaaactattgaagaaaatacaagagcgtgtgtggatgagatccgtaagattctgagcaggcaggatggaagaagggaatggttccttgcagttggtcagtctgtggagcgtctgagtcagatacaaaagagctatcatacggcatcaagagccttttcgcagagatatctgtatgatgaaaatattctttactatgatgagatggaaactatggagcatcctggtggacaggcggagactgaagataatgcctatctgcagaaagtggatgtgaatgccctgaatccggcaatccttcagaaatttttgagcaatggtcttcaggaagagacagaaaactttgtaaaagactatttttatgcaatcggtcaggagccgatggaatcactggtatttcgaaattatgttattctgaatgttcggttttctgttatttcattcattaaagggctgggatgtgatacgaatgaaatggaatctgcagatacagaagaagtacttgcagagagtggaaagaatatggaaagtgcaattgcttatgcgaaaaaaatgatctcacaggcaatcgagatccgtgaccagaattccggaaacaaaaaccgcagtattttaaaaaccgcggtggactttattgacagccattatatggatgaagagatttcactaaatacggttgccaatgttgcaaatgtcagctctaatcatttcagcgctctgttcagccagaatatgggacagacttttattgagtatctgaccacactgcgtatgaataaagcaaaagagcttctgcgttgcacaggtatgcgttccagtgagatcgcaggagaaatcggatataaagatgcacattatttcagctatctttttaagaaaacacagggtatgactccgagtgattaccgtaaggcacgggaggaaaaagcatgagaggagtacctcagaaaagaaaaaagcagatgggacttgagaaacgtatgaacagacttctgttcagtacgatgattccgatggcctgcctgctggttattttgcttctgatcttctggcagtatgccggacagtataacaagctgtcagagaatctggcggtcagcagtaaattcaacctgagcttcaaggatgaactggatctggaaatgtattatctggcaatcggctcaaaagaagccagtgaactggatgacgttgtgggacaggtagaggatgcacaggagattatggaaaaactgcgcaaaaatacataccatgccagtggcgtcaaatgtctgaacagtctggatgcgtatctggataatctgaaaaagagaatgctccagctgatggagatcaaggaatatgataaacgaatggaatttatggacagtaacattcgtattatcacaggcctgatcatgcaggagatgcagaattatatttataatgaatccatgtatcttgtgaaggtcgagacgaatcttacccacagagttaagatcctgatatcgggaatggcggtattattacttgcaacgctgggaattctgatgcgaagatcgttccgtctaactggtgggatcatccaaccggtaaccgagatgcgagataaggtgaagaaagtaggaaagggaaatttcgatgttcttccggtgtctgcggagattatagagattgaggaactggaccagggaatcaacaagatggcacacaggatcagtggacttctggaaaatgtccggcaggaaaaggagatgcagcatctgacagaactgcagctgatccaggcacaggtcaatccgcattttttatataataccatggatacgatcgtatggctgatcgaaggtggtatgacggatgatgcagtggagatgatttccagtctttctattttcttccgtacatcgctttccaaaggaaatgacatcattcctctttcagaagagaaacgacacactttgagctatctggagattcagcagttccgctatcgcgatattctggagtttgagttatccataccaaaagaacttgatggaatacaggtaccgaagctttccattcagccgctggcagagaatgcgctttatcatggtatcaaaaaccgtcgtggaaaaggtaagatcacgataaccggcagggaagaagcggatgcgatcgttcttacagtcagtgataatggacagggaatgacaccggagcgtcttcatgaggtacaggaggcaatacgtacaggagagagagccggattcgggcttgcggcagttgcggaacgtattgctttgtactacggaccgggctacggaatgacgatttcttctaaagaaggagaaggtacaacggtggaattacggcttgggaaaaatattcaaccgaaatcgtaaaaaatccaacttgttaaaaatgagacagaaagatagataaaagactaaacttttttccgaaaataatccatggagttttcgtaacaaattgctataataaaaccatcttaaaaaacacgaaacaaatgtaaagggaggattacaaaatgaagaaaaaaatggtgaccgcactcttagcagtatctatgttggcaggactttccgcagtgaatgttatggcagcggacgacgacacaattacagttggtttctcacaggtaggtgcagaatctgactggcgtactgcaaacacagaatccatgaaatctactttctcagaggataacggatatgaactgatctttgacgatgctcagcagaaacaggagaatcagctgacagcgatccgtaacttcattcagcaggaagttgactatatcgtacttgcacctgtaactgagactggttgggataccgttcttcaggaagcaaaagatgcaggaatcccggttatcatcgttgaccgtatggtagatgtatctgacgacagcctctacactgcatgggtaggatccaacttcaaacttgaaggtcagaaagctatggcatggctggatgcatatctcgaagcaaaaggccgtggcgatgaagaaatcaaccttgttgatattcagggaaccatcggagcatctgctcagatcggacgtacagaaggatttgatgaagctgtagaagctcatgacaactggacaacacttgctcagcagtccggtgaatttacacaggctaaaggacaggaagttatggaatctatcctgaaacagagcggtgatgatatcgacgttgtatactgcgagaatgataacgaagcatttggtgcaatcgatgcgatcaaagcagcaggatatgaagttggcggcgaagaaggccagattcttgtaatgtccttcgatacaacaaacgcaggtcttacacagacactttccggcgaaattacatgtgatacagagtgtaacccacttcacggaccacgtgtagaagagattatccagaaactggaagccggcgaagatgttgataaacaggcatttgttgatgaagttgcatttgcatctgatgatacagtaactaaagtaacaatcgatggaacagattatgacatcacaccgatcactcaggaaatcatcgacggacgtgcatactaatctttgaggcataaaactgcaaactgaaagagatttataagtaatgagcccggggcgtggaacaggatccagatggtatggattttatgggccacgccccttttgcgctcaaaaaagggaaaataaaggaaaaaatggaataaaacagggaatggaggaaagaaaatggaacaaaacgttgttttggaaatgcgtgatataagtaaaaatttcaccggtgtccgtgccctttcccatgtggattttacacttcgcaaaggtgaaatccatgcactgatgggagaaaacggagccggaaaatcaacactgatcaaagttctgaccggtgtacatgaattcgaaagcggttccattcatatgaatggtgaaaataaagacattatcaatcattctccgcaggaggcacaggcaaatggaatcagcacggtttaccaggaagtaaacctctgtccgaacctgactgttgcggaaaacctgtttattggccgtgagccgcgaaacaaggttggaatgatcaactggaaagaaatgaatgcacgttctgcaaagcttctggaaagcctgaacattaatgttccgccgacacagatgttggatgaatgttctgtagcgatccagcagatgatcgcgatcgcacgtgctgtggatatgaaatgtaaggttctgatcctggatgagccgacttcctctctggatgatgaagaagttgagaaactgtttgttctgatgcgcagacttcgtgaggaaggtgttggaatcatcttcgtaacacatttcctggagcaggtatatgcagtgtgtgaccggatcacggttcttcgaaatggtgagctggttggagaatatgagaccaaagatcttccaagagttatgctggttgctaagatgatggggaaagattttgatgatcttgcagacatcaaaggcgatcgtaaagataaaaaagtattctccgaaactccggtcattgaggctgagggtattggacataagggaacgatccggccatttgatcttaagatcaataaaggagaggttatcggtcttaccggtcttctgggatccggacgttctgaactggtacgttccatttacggagctgacaaagctgacagtggtacattgaaggtaaatggaaaagaagtaaagatcaacagtccgctggatgccatgaagcttggtatggcatatcttccggaagatcgtaaggcagaaggtatcattgctgatctttccgtaagagaaaacattatcattgcaatgcaggcaaagaaaggcatgttccatccgatgagccgtaaagagatggaagaggcggcagataaatatattgatatgctgcagatcaagactgcaagccgtgaaactccgattaagagtctttccggtggtaaccagcagaaggttatccttggccgctggcttctgacaaatccggaatatctgattctggatgagccgaccagaggtatcgatatcggtaccaagaccgagatccagaagatcgttcttgatcttgcagatcagggaatggcagtaacctttatctcttcagaggttgaagagatgcttcgtacctgctccagaatggcagtccttcgtgatggagaaaaggtaggagaactggaagagagcgagctttcacagagcaatattatgaaagcgattgcaggaggtgacgataagaatgaataaagctaaattaaaaaagatcacgagtgcacgactctttcttcctatcgtgtgtctgatcgcggtccttctgatcaatgtgatcaagactccggacttctttaatattacgattcgaaatggtgtcctttatggatatgttattgatgttatcaaccgtgcatctgaactggtaatccttgcagttggtatgacacttgttacagcagcatccggtggacaggatatcagtgttggtgcagttatggcggttgcagcagctgtatgctgtcagatcttatctggtggtgcatcttccgtaactgaatatcagagttctctgattcttgctgtaattgcagcacttcttgcagccgcactctgtggtgcatttaacggatttctggttgcaaagctgaatatccagccgatggtagcaacgttgatcctttatactgcaggacgaggtatcgcacagcttgttacaaatggacagatcacttacatccgtgttccatctttccagatggcaggtggatatatcggtaaatctccggttccgacgcctgttcttttcgcaatcgtaaccgtagttatcgtagctttgattttgaaaaagacagctcttggactttatattgagagtgttggtatcaatggtaaagcagcacgactggtaggtctgaactctaccatgatcaagttcctgacttacgtgatctgcggtgttcttgcaggaatcgccggactggtagcatccagccgtatctattccgcagatgcgaacaacattggtctgaaccttgagatggatgccatcctggcagttgcacttggcggtaacttccttggcggtggtaaattcagcctgatcggttctgtaatcggagcttatacaatccaggcactgacaacaactctgtatgcaatgaatgtaaaagccgatcagcttcctgtttataaggcaatcgttgttatcatcattgtaaccttacagagtgatgtatttaagaaattcgttgcaaatcacagaagcaaaaaagtttccgttgcagcagagggaggtcagaaataatgaaacagaaaaagaaaatgacaagtaccggatttctgctgttgatcacaatcgttctgttcttcgttatgtatgcagcaggtatggtgatctttgcagataaaggttttgccaaaccgcagatgtttctgaatctttttgtatcaaatgcaggtcttctcgttatttcctgtggcctgacgatcgttatgatcaccggtggtattgatatctccgttggttctgtaacagcacttgtctgcatggtaatggcagaccttatggaaaacaaaggcgtgagtgcatatgtggcagttcttgcagcacttctgatcggtcttgcttttggtatcgtacagggattcctggtaacttacatgggaatccagccatttatcgtaacacttgccggtatgttcttcggacgtggtatgacagcaatcatcagtacagacatgatctccatcaaaaacgaagtattcctgaaatgggcaaactaccgtttctacatgccatttggttctacaaacaaaaaaggtaaatttattccggcatacattccgccgacagtagtgatcgcaattattgtagttctcattattgcagtgcttctgaaatatttcaaattcggccgtaaactgtatgcaatcggtggaaacagacagagtgccctgatgatgggtcttgatgtcaaaaagacaatgttccgtgcctatgtactggatggctttcttgcaggacttggcggattccttttctgcctcaacagctgcgccggtttcgtagagcaggcaaaaggtcttgagatggatgcaatttcttcagccgttatcggtggaacacttctttccggtggtgttggtaccccgatcggttccttgttcggtgtgctgatcaaaggaacgatttccagtctgatcacagcacagggtactttatcaagctggtgggtacgaatcgtactttccgcactgctttgcttcttcatcgtgatccagtctgtactggcatctgcaaagaagaaaaaatgatcaaagaaaaatatatggaggttttttgttatggttacaggtagaaattataagttctggttttgcacaggctcacaggatctttatggagatgaatgcttaagaaaagttgcagaacactcaagaattattgttgaggaactgaacaaatcaggcgttcttccttttgaactggtgtggaaaccaacattgatcacaaatgagctgattcgtaagacttttaatgaggctaatgcagacgatgaatgtgcaggtgtgatcacttggatgcatacgttttctcctgcaaaatcctggatccttggactgaaggaatacagaaaaccattgtgccatctgcatacacagtttaaccaggaaataccatatgacacaattgatatggatttcatgaatgaaaaccagtctgctcatggtggaagagagtatggtcatatcgttacccgcatgggaatcgagagaaaagttatcgtcggacactgggctgataagaaggttcaggagagactggcatcctggatgcgtaccgcagtcggcatcatggaaagtagccatattcgtgtctgccgtgttgcggataacatgagaaatgtagctgttaccgagggcgataaagtagaggcacagataaaattcggatgggaagtggatgcttatccgatcaatgaagtatgcgattacgtgaagaatgtttctaaaggagatgttgatgttttagtcgaagaatattataataaatatgatattcttcttgagggcagagacccggaagaattcaaacgtcatgtagcagtacaggcagcaattgagatcggatttgagaaatttctggaggagaaaaactatcaggcagttgttactcatttcggagatcttggcagtttacagcagcttccgggacttgcaatgcagcgtctgatggagaagggatacggattcggcgctgaaggtgactggaagaccgcggcaatggtacgtctgatgaagatcatgactgctggtgtgaaggatgcaaagggaacttctttcatggaggattatacctataatcttgttcctggcaaagaaggcattcttcagtcgcatatgcttgaagtttgcccgacgatcgccgatggtaagatcggcattaaggtatgcccgctttccatgggtgacagagaggatccggcgagacttgtatttacatccaagactggtccggcagtagctacttctctggtagatctgggagatcgtttccgcctgatcattaatgatgttgattgcaagaaggttgaaaaaccgatgccgaaacttccggtaggaagtgcgttctggactccgcagccggatctggcaacaggagcagaggcatggatccttgcaggtggtgctcatcatactgcattttcctatgatctgactgctgaacagatgggtgactgggcagcagcaatgggaatcgaagctgtctacattgacaaagatacaaccatccgcaactttaagaatgaactgagatggaatgaggtcgcgttcagaaaataaaaggcggatgtggcaaacacagaagtcgggaggatttacaatgagtgtaaacgaagcaaagacagctattttaaacaacaaaacagcactcggaatagagttcggatctaccagaatcaaagcggttctggtagatgacaaatataatccgatcgcatccggaagttatgagtgggaaaaccgttacgaaaacggtgtgtggacttactctctggatgacattcataagggattacagggaagttacagtgatctggtaaaggatgtacaggaaaaatacggtgtggagcttaccagtgtcggagcgcttggaatcagtgccatgatgcatggatatatgccttttgataaagaaggaaatcttcttgtgccgttccgtacatggagaaacaatatcacaggagaagcatccgaaaaactgatggagctcttccagtacaatatccctcagagatggagtattgcacatctgtatcaggcaatcctgaatggtgaagagcatgtaaaagatattgattacatgtgtactctggaagcctatgttcaccgcatgctgacaggaaaaagagttcttggtatcggtgatgcagcaggaatgttccctgttgattcggagaaaaaagattacaaccaggaaatggttgagaaatttgataaactggtagagtcatatggtttcccatggaaactccgtgacattatgccagaggtcatggttgcaggacaggatgccggcactctgacagaagaaggtgcaaaattccttgatcctacaggaaaactcaaagccggaattccgatgtgtccgccggaaggtgatgcaggaaccggtatggttgcaaccaacagtgtgaaacagcgtacaggtaatgtttctgcaggtacttctgtatttgcaatgatcgttcttgaaaaagcactttccaaaccatacaaagagattgatatggtaactacaccggctggtgatgcagttgccatggcacactccaataactgtacttctgacctgaatgcatgggtaaatgtattcaaagaatttgcagaggctatgggaatggaagtggatatgaacaagctgtttggaacactttacaacaaagctatggaaggtgacccggattgcggcggacttctgtcctactgctatttttccggagagcatatgacaggatttgaagaaggtcgtccgttatttgttcgttcccctgagagtaaatttacacttgcaaactttatgagaacaaatctctacacctgccttggagcaatgcgtgtaggcctgaatatcctgatcgaccaggaacatgttaagattgacagactcttaggacatggcggtctgtttaagacaaaaggtgtcggacagcagattcttgcagatgcagtgaatgcaccggtatctgttatgtcaaccgcaggagagggcggcgcatggggtatcgcgcttctggctgcttatcttgtcgacaagaaagacggagagactctggatgaattcctggacaaccgtgtatttgccggaaatgaaggaagtactcttgatccggaaccggaaggagttaagggattcaacgaatttatggacagatatcttaaaggactgccgattgaaagagcagcggtggaatctaagatctggtaagaaatgataggactgcagggtactgtgaatggcacagtgcccttgtgttgtataaaaagaactgcgtaaaggagaaaaagtatgcttgaaaaattaaaagaagaggtatatagagcaaatatggacctgccgaagtacgggctggtaacatttacctggggaaatgtcagtggcattgaccgtgaaaaaggtctgtttgttattaaaccaagtggtgtggaatacgataagctgagaccggaagatatggtagttgtagatcttgaaggaaataaagtagaaggcgaatataatccatcttctgatactccgacacatgtggttctttataatgaatttccaaatatcggaggaatcgtacatacgcattctgaatgggcaacgagctgggcacaggcaggaagagctatcccatgttatggaacaacgcatgcggattatatttatggagaagttccatgtgttcgaaatctgacaaaagaagagattgaagaggcatatgagaaaaatacgggtgttctgattgcggattatttccgtaaactggattatgaagctgtcccggcagtactttgcaagaatcatggtccgtttacctggggtaaagatgcgcatgaggcagtgcacaatgcagttgtacttgaggaagtggcaaagatggcatgccgctgtgaactgatcaatccacaggtgaaaccggcaccacaggaactgcaggataagcattattaccggaaacatggtgcaaatgcttattatggacagattaaaagatgataaaggattcccggtgaggaattgtgaaagagtactccggtggagttaacttgtgaattatcctctgaatatggttcaattcaaaaattctaaagtatcaggaagtacaggactttgctaaaggcgatacataaaatgctgaactcgcatcaaagatgctcagacagcagcattttatgcatcaacgcaaaaacctgcacattccgatacttggacgaattttttcaggcgaactcatttcagaggataattacaggttttctccgtcggagttttttcaataccgcaccggactttatctgggacagcggcgacgccggaggatacgtggggatatgacagcgcgcagcgcgaccaggagcccaccaattaaaacaaaagaatctctggaaatataaaagctccctgtcgggaaacctctgcaggaatttatagaaacacttagaggattctctttctgtgttatggattgaaaagtgcattgtctgagccgtaaggcgagttatgcactttttatccatggttttaacagaaggagaatactcctagtgtttctgaattccgaagctgtttccagacggggagttttatataacggagaaattcattttgttttaaagctcatttagtaatctcttccggtaaacacggccacgctcctcggccgcatcacgaaacttctgtcaatccggacttcctgtccttccggatagcagtaatgcccgtttccatctccatacgtattgacgctcaagtgccatgcgcctcttccgtgaagatttggaagcgtgatcgtgacgtcttcccagaaagtattgactgcgacatagatcaggtcatcttttcctttttctttatcgtatcccgcaaagcttacacagaaggtacgtgcatctcgtggaatatctgtttcctctgcattcagattatatgtatggataggatccatgccgcagacggatgtgggcagctgtttgtggatgaccggatgctttttgcggaatgcgatcataaatttaaagaattcaaacagatctttgttcttttcgagcatacgccagtccagccaggaagtaatgttgtcttggcagtagctgttgttgtttccgaatttggtattcccaaattcatcaccggcaagaaacattggtgtgccgcggctgcacataaggacagcacaggcattccggatcatacggcggcgaagtgagaggacttccggatcatcggtctcaccttcgacaccacagttccagctgcggttgtcattggccccgtctgtgttattccagccgtttgcttcgttatgtttgtcattgtacgcatatagatcgtacagtgtaaagccgtcatgacaggtcagaaaattcacgcaggaattgtaaccggcatagttgctgtgggtattgtcgtaatagccaccatagagatcaccggagccggagatactccaggctgcatcccatgcattccaggaatcccctttcagataactgcggagagagtcacggtatctgccgttccattctgcccagcggccgcttgcagggaagcttcctacctgataaagaccgccggcatcccatgcttcagcaatcagttttacgttgcttaagattgaatcatcggcaagagtacggagcagaggcggattattcataggagagccatcttcatttcggccaaggatacttgccagatcgaagcggaatccgtctacgcggtaattgatcgtccagtagcgcagacattcgagaatcagctgctgaacgacagggtgattacagttcagggtgtttccgcagccgctgaagttgtagtaattgccatcaggagtcagcatatagtaaatattgttgtcaaatcctttgaaactgaatgtgtttcctttttcgtttccttcggcagtgtgattgaaaacaacatccaggattacttcaatcccgttgtcatgaagtgctttgatcagtgttttcaattccgtaccttcctggttatgttcatttgcagcggcatagctgctgttcggagcaaaaaatccgacagtgttgtatccccagcattcgagaagttgtttgccatctacggtacgggaattcatggtctcatcaaattcgaagataggcatcagttccactgcattgattcccagttctttcagataaggaattttttccataagtccggaaaaagttcctcgatgctgaacaccggaagaaggatgatgagtaaaatcacgtacatgcagttcgtagatgatcaggtcacagagttcttttttggactgtggcatatcaccccagtcgaaacggtctttgacgacacgtgcatgatacgtatggtcccagcggattccccaggtacgctgacctgcaactgctttggcatatgggtcgagcagaattttatttttgtcaaagagcagtcctttttccggacagtatggtccgtctacacggtaggcatattcaaattcatcaatgttcagtccatatacgatcatggaataaacatcaccgatcttgtaagcttccggaaaaggaagtacagcaaaaggttcttcctgtgcacggtggaacagaagcagttcacaggaggttcctccgcatgtgtgaatggtaaaattaacaccattctgcaaaggagtagccccgttcagatcgtaaattcccggacggaccggaaaaccggcgatttctgccataggggaagattcataaggatggtcagatacaaatttctgatgataggatttcatttttttctccatttctgaagctcccggcctgatgtacagaccgggagcttgttttgtatagattcttgtgtcggaaaatttttataaatcgtttgtcagatgcagcttatcaagaatatagaagataaggcttaaagccatggctactacacaggcaaggaccattccggtgagtttgacgttgccaagattcagggcgattccggaaaggcctacgataaagactacagaagtcagggccaggttacgggatttgctgtaatccacctgattgtctacgagcatacgaagaccggaagttccgatcataccgtacagcaggaaggagattccaccgataaccggtcccggaatcgtgttgatcagggcagcaagtttgccgaggaaagagcagcagatagaaagaactgcagcaccaccaatgacctgaacgctgtaaacttttgtcatagccataacaccgatgttttcaccataagttgtagtcggcacagaaccaagacatccggatacggtagttgagaagaaatctgcaaaaagggaacgatgaagtccgggatctttcagcagatctttgcctacgatcttacttgtcacgatctgatggccgatgtgctcggaagtaacaagaagcagtgccggaagaatggtcaggattgcctccagattaaatttcggtgcctgaaaattcggaagtgcaaaaaaagcagcttcttttacagcagtaaaatcaagaattccgcaggcagctgcggctgcatatccggcaatgatcgcaatcaggattggaataacggataaaaatccacggaacaggatctggccaaatacagcaacaccgagtgtgaccagaaatacgatcacatttttcatatcgatctgttcgtccagaagcccggcagtgcttgctgcgcttccggcaagctccagtccgatcagtgcaactaccggtcccatggctgcggttggaaggacaatgtcaatccagttagttccacactgatggatgatcagagcaacgatcataccgcagatgccgaggacaacaaatccgcccagagcatactggaaaccaaatttggaggcaaccaggagtccaggtgacaggaatgcaaaactggaaccaagataggccggtgctttacctttggtgatcagaatgaacagaagtgttccgataccgttcatcagaagaacgatggcagggttgataccgaacataaaaggaaccagaacagaggcaccgaacatggcaaacatatgctggatgcttaaaggtattaacagattaacaggtactttgtcttctacttggataatttttctttccacgttaccctctctttcttatctgcatgcggcagataacatttaactaagtgaccgtttacaaacggttacgattctgaacaattataccatagaggagctttcattactatttaaaaataaatgtgcagaatgtaaaaataatatgcaggaataaaaagtggatgtgagtgggggaggtggttataatttggacaaaaatagggtgcatattggtgaaatgttgttgcttttttcaatattttatattataatcttgtttgtaaaaagaatttacccttcaaaaattttttttacataaccccttatttaattatttatactccccttgaaatacccggtagctcccctatcgggtatttctctgtttaaatatggaaaatcatggaagttttctggctgttttataaagaatccaggcagttatgaatagtatcctgttcttctggtcataataatggatgtaatgaaattgctgcaaacagtaatcttacattacaaaacgaaccaggaggaatggacaaatggcaaaaaattacgaaaatgaaaacaaagcaaaaaactacagcacagataaaacttcagacaaaaatgcgatggacagccgaaacagttccaaaaacagctctaaaaatgcttccagaaacagttatggaaacaaaacatccaatgcatatgacaaagagcagaatgattattctggcagatactaaggaagaataaaacaggattttcccttctcttgcaaagaggctggctatgtgccggcctcttttgctgcctgcagataaggatggtattgcttgggaagattgaagaggcagatcgtgcaccgaaaagaaaagggaacatatgataaataaaaaaggaaggtttgtcatgtttcctattgaaacaatctcagccaggatgcttgattattatgtggggcgaaacgatgctttgatcatagatctgcgagaagaaaaagcatatgccgaaagtcatgtgcggggagctgtaaatattccatatgaaacactggagaacagaaaagatcttccaatgaataagatacttgttttttactgtgacagaggcggtgcaagcatggcagccgcaagagaatttgtcagacggggatacaggacacgttcggtgatcggtgggtttacggcgtaccgaggcagaaatcttgtgagtggagacaggtaatgaaatcttgtaatttccctgtaaccatgataaggtaagaaagagaaaatgttattattcagaggagaattaagtatgaaatacatgtttgcatctgatgtgcacggctcggcatactattgccggctgatgctggagaaatataaagaagagcaggcagaacgcctggtgctgctgggcgatctgctttatcacggaccgagaaatgaccttccgaaggaatatgcaccgaaagaggtcatcaaaatgctgaatggcatgaaaaatgatatttacgcagtaagaggtaactgtgaagcggaagtggaccagatggttctggaattcccggtaatggcagattactgtattctggcaattaacggacttactttttatgcgacgcatggacatgtctataatgaaaataatcttccaccgttccacgagggagacattctgatacatggacatacacatgtgctgaaagcagaacaaaaagaagggtatatccttctgaatccaggatctgtatctattccgaaagaaggaaatccgcctacatatgctgttctggaagacaaaacatttacgattaaagattttgatggaaatatcatcaaggaaatgaggcttggatgaaatatatggaattgatcgcaccgtgtcactttggcatggaagcggttctgaaacgcgagattctggatcttgggtatgagatcagtaaggtagaagatggcaaagttacgtttctggcagatgcggaaggtattgcacaggccaatatgttccttcgtacgacagagaggattctgctgaagaccggagagtttaaagcagtgacatttgacgaactttttgaaaaaacaaaggcgatcccgtgggaagaatatattccgaaggatggcaagttctgggtagcaaaagccaattctgtaaagagtgcgctgttcagtccttctgatattcagtccatcatgaaaaaagcaatcgtagaacgcctgaaaagtgtttatggaatttcctggtttcaggaggatggtgcaagcttcccgattcgagtagcctttatgaaggatgtggctacgatcgggattgatacatccggagtttctcttcataagagaggctatcgtcagatgactgtcaaagctccgatcactgagacgctggcctctgcactgatcatgttgacgccatggaataaagaccgcattcttgtggatccattctgcggaagtggtactttcccgatcgaggcagctatgattgcggcagatatggctcctggcatgaaccgttcttttcttgcggaagactggaaacatctggttccgcgcaaatgctggtatgatgcactggaggaagcgcaggaccgtgtgaacctggatatagatacagatattcagggatatgatattgatccggaggcactgaaatctgcccgtgccaatgcgaagatggcaggagtggataagctgattcattttcagcagagagcagtcaaagatctcagtcatccgaaaccatatggatttatcatcacgaacccgccatatggagaacgtctggaagaaaaagaagcacttccacagttatacagagagattggagagagttataatcgtctggacaagtggtctatgtatctgatcacatcttatgaccgtgcggaaaatgatattggacgaaaagcggacaagaatcgcaagatttataatggtatgttaaaaacatattattatcagttcctgggtccgaaaccaccaaggaggaaaaaagattgaaaaaagtaatttttgcaaccggtaatcagggaaaaatgaaagagatccgggaaatcctcggagatctggatattgagctgctttctttaaaggatgcaggaattgatgcggatatcgttgaggatggtaaaacatttgaagaaaatgcccagatcaaggcaaagacaatctgtgacctgacaggtgagatcgtgctggcagatgattccggacttgagattgattatctgaataaagaacctggaatctattccgcacgttatatgggagaagatacttcctatcatattaagaatgcaaaactgatcgagagactggaaggagttccggatgagaagaggactgcaaggtttgtgtgtgcgatcgcagcggcatttccggatggaacgatgaagactgtgagagcagcgatggaaggcagaatcggatataaagagagcggagaaaatggttttggttatgatccgatcttttatcttccggaatacggctgtacttctgccgaactttccatggaagaaaaaaataagatcagccacagagggaaggctctgcgtgcgatcaaggatgaacttcgatgaaggtactgatcgtcagtgatacccatgggcacgatgaaaatctggaaagagcggtgatgatggaaacgccgtttgatatgctggtacattgcggagatgtggagggccgtgagatttttatcgaagctcttgtggactgcccctgctgtattgttgccggcaataatgattttttctcagaccttccgagagaagaggagatagaacttgatggaaataaggttcttgtcacgcatggaaattattatggtgtgtccatggatatttccggtgtcgcagaagaagcaaagtccagagactgtgatgctgtgttctttggacacacgcataagcctgtaattgaagaaatagacggtgttctggccattaacccgggaagtctgtcctatccacgccagcacggcagaaagccaagctatgtgatccttgagactgataaagacagaaagatgtctgccaagatcaaatatctgtaaaatgatttaaacaagtatgtataggggactctaaattgttcgggttaagattcagggaaaacaaaataatagaatgtcaaaacagcaggaaatcttctccatacgagagagaagtctcctgctgttattctatacatatcctatttgaaaaacgaagaagtcctttgcttctcagccaagggtgtgcagagggaatggtaagtccctttgcaatccttatgatttaaataaaatgcggatgacaggacttgaacctgcacgtcgtagacaccagaacctaaatctggcgcgtctgccaattccgccacatccgcaagataaacaataaacagacaaaacggaattgtcataaattccaccacatccgtatattgtttgatatattcgtgtgtaacataaaagataaataaaaacactatcgaaatgatagtgttcttaaaaatcaatgagacatcggggattcgaaccccggacaacttgattaaaagtcaagtgctctaccaactgagctaatatcccatataaaagactgggctagctggattcgaaccagcgaatgcagcagtcaaagtgctgtgccttaccgcttggcgatagcccaaaggcgagggtggatacagggattcgaaccctgggcctccagagccacaatctggcgcgctaaccaactgcgctatacccaccacagcgtgcctgaagggattcgaacccccgacccacggcttagaaggccgttgctctatccagctgagctacagacacattcctctgtttgcaacagagaagcgggtgatgggaatcgaacccacgtatccagcttggaaggctggtgttctaccattgaactacacccgcatgtcgctgaaacggtattgtttacagcatcggggtgacaggattcgaacctgcggcctcctggtcccaaaccaggcgctctagccaagctgagccacaccccgttaacggtatttaattgtttgcgtttggctttgtcgctcaacgcaagacatattatattatagtgatatgcaaatgtcaacaacttttttcaactttttttcgaaaaaagttttaagacctaaaaaacattgattttacaggggtttcaggtggaaaaaagttttatattttattgcgaaaagagtaaaaattatagaaaagagatagattttcttggaaaaaacagagaaggatgttacaataaaaaaacggagaaaaaatgaaaaataacagtgtgtttaaatgatcttaataagataatgacagatgaactgtcggaataaaggagaactgtgatgaacgtacaggagtttcagaataaactaaaagaagtgcaggaaattgccagacaacatgggaatgcgttaaatgcagccgaaatccgtcaggtatttgaagagtgtgacctggacaaaagccagttgctgggtgtattaaaatatcttacttctcagggaattctcattgaaggtctggaaacggcaggagaagaagcaaaggagcctgaacataaaaaaattcctcttacagcagaagaagaagcttatcttaaaaattatctggaggaactgccggttgttgatgaggtggatgctgacagtgtatttgaagctctggcagccggtgatcagagggcacttcagacacttagttcttattatatgaaaacggcggcagatatggctgttgagatgaatatagaagaaatgcagctggccgatctgattcaggaggcgaatctgtgcctgatccaggcgcttggaactgccggtgatgaatgcagagatgagaagtggcttctgagtgaaatgcgcaaaggaatccagcttgttctggaagaacagacacagagaaaattcgaggatgacagtctggtagcgcgtgtggagaaactggaaagtgctgttcgagaattaaatgacggagaggatgagaagaatgcatttacgatcgatgaactggcaatcatccttgatatgaaggtggatgagatccgcgatattcttcgtctgaccggtgatgataattaagacatacagtggcgcctaaacaaagttagataagaaaaacaattgttgaattcagggtaatcctgtggtattatgtacctaaatgggaggtattttttatgcaaatcagagaatcggcagaggattacctggaggcaatccttgttttatccaaaaaaggcggcggagttcgttctgttgatattgcgactatgctcggggtatccaagccaagtgtcagccatgcaatgaagcttctcagagaagacggttatattgcgatggaccgttatggaacggtgacactgatggacaaaggtgctgagattgcaaacagaatctatgagcgccataccgtcctgacaaagatgctggaaggccttggagtatgtgatgagattgcccgggcagatgcctgcaagatggaacatgatgtcagtgatgagagttttgagaagataaaagaacatctgaaagcaaaaggcgagatttaattactgttcacaggtaatatctcgagacatacgagatttaaacagattgcagagtgaatcagagcttttgtattcgtttaaataaaatatgagataaaaaggtcgtcacgatcagagttgaatcagatcaattctgacagtgatgaccttttttggtataattatgcaacgcagcaaaaccaattttatcagaaagcagttcctttttgtggcaactgagctaggatgatcgcaccaaacatcagcacgcagccgaaaatttcgcgactactgagattttggccgagaatcaaccagccagcgataacagagatacaggattccaagctgagaatcagggaggctacagttgggttcatatttttctgaccgacgatctgcagggtgtaggcaacgccacaggacataactccggcatagagaaccggagtttttgcggcgaaaattccggcaagatccggactttcaaagatcagcgccgggattccggagaggattccacagaccagaaactggatacaggacatttttacaccatctaccagtggtgagaaatggtcgattgtaaggatatgtaaggaaaacaggaaagcacagatcagtaccagaagttcgcccttgccgatggcaaatccctctcctggagtcagacaaagaagataaagtccacacagggaaagaatgacagcaatccagataaacgggctgcatttctttttcagaaagataccgatgatcggaacaatgacaatgtaacaggcggtgataaagccggctttaccaacgctggtgtatttgatgccaaactgctggaagttgcttgcaaagcagagcaggataccacagcagataccgccggtgattaatgttttgcggtcggaagatgcttgaatacgttttttttcttctggtgcttttgttttgccaagtccccagatgaccggcaggagtgtcagtgcaccaataagattgcggacggcattgaaagtaaagccgccgatgtagtccatgctgacactctgggcaacaaaggcaacaccccagatagttgcagtcagaagcagtaaaagagaattcctgaccggaatagattcttttttcataatgtttctcctcgtgtgataagatagcgggtttcaaatgtatatgcccattcatgcgagcatgaagctcatatccgctttaaacccttgtatctttgtattatactgcataggtatgcattgataaagagtgaaaataaaaaaataaggactccgcatatgcagagtccctatgaataattttcaagtcgaacatccgtaagacctggcgcgtgattcaggtcagcataagctgacatcttctttacagaatcactgcgcatccttgttaagatcagatgaaaatatatttcagtacaaataatatggcaagaacgtacatcagcacactgatcttcttttcttttgcctttccggtaatcagattgatgactacataagagataacgcccatggagataccttcggaaatgctgtacatgaatggcattgcgataatggcgataaagcatggaatcgcttctgtcatatcactgaagtcaatttttgtaacagatgtcagcatcaggtagcctacaacgatcagagccggtgcagtggcaaaggaaggaattgccaggaagattggtgagagcaggagggaaagtgcaaacagaatacctgctactatggaagtaagaccagtacgaccgccttctgcaacaccagaagcactttctacaaaggttgtaacggtagaagtaccgcaaacagcacctacagttgttccgactgcgtcagagagaagtgcacctttgatttttggaagtttgccgtctttgtcgagcatatctgccttggaagctacgccgatcagagttccaagcgtatcaaacatatcaacaaacaggaatgcaaacatgatgactacgaaatccagtgagaatacaatggaaaaatccattttcataaaggtgggagccatacttggtacagaaattccgtttgaaaaatctggaagcaggctgtaataaccaatgtctgcatttggtacatacagatgtgtcagctggcagatgattccgagaacccaggtgatcaggataccccagagaatacttcccttgacatcttttgccagaagaacagcggtcaccagaataccaatcagagccagcagtacggtgattccctgagaggagaaggtcccttctgctacagaagatttgaaggaaaagatgcttaccagtgtggaatcatttccaacaacgatcttggcattttgcagtccgatgaatgcgataaagagaccgatacctacggatactgcgtgtttcaggttcatcggaatggagttgaagatcgcttcacgtacattggtaagagaaagcaggataaaaatgataccttctgcaaagactgctgcaagtgcctgctgccaggtgtatcccataccgagaactactgtgtaggtaaagtatgcgttcagtcccataccaggagcaagaacgaacggatagttggacagaagcgccatcagacaggtggcaatgaatgcggacagtgcggtggcggtgaagacagagccgcggtccatgccggaagcagacaggatgtttggattgacggccagaatataagccattgtcataaaggtagtgattcctgccataacctcagttttgacatctgtgtgattttctttcaggtggaaaattttgtcgagattcatataagtacccccttcgtgttgtgcagacgtatgcactaaaagattttgtttccggaaatatattttccggtgatgcagctgtcatctgagagatagatcagtcgttccagacgttctctggccgtcagaggctgaggatgccggagtttgctgtcatccagaatcagtgcatcaaactcatagccttccgcgaaagtcccgacttttccgaaaaatgcaccgccacccatggtagccatataaaaggcttcttccagtgaaagtggtttgagggaatcgtccaccagtctccagcgaagcttggatacctgaatggcatctgcaatcgcacggagcatggaaagggaatgtccgcctgcaatgtctgtaccgagtccgatatggagcccttcttcaatatagcgtcttgtcggtgcgataccggaagaaagattcgtattggactgtggacagtgtgcgatgaatacgccccgttctttcatgagagagagctctgcgtcagaactgtagacgcagtgagccatgatcgttgggcattgttcaccgccaaatagtccgaactgatcgtaggcttctccatagaaagaagttccttgacataattcctttacccaggcgatttccccctggttttcggaaaggtgagactgtaccggaagacggtaagttctctggatctctgccagtctggtcataagttcatcactgcaggaaggggtaaagcgaggagtgagaatcggtttgacattctcgtattttcctgtagtttcttcaagccagcggacagtatcttttgcagaaacaacagcacttgcctcctggagagccagggagccgttgcggtccatatttacctttccgatgaaggtcttgagaccggttttctccatcaggtccatcagaagttctgttgcatctacatgtaaagtgccgaagatagaagcacgtgtggttgcactgtgttttatatcgtcggtgaagatggaataggctttctctgcgtaatttagatcggcatatctggcttcttccggaaatgtgacggtattcagccagtccagcagttcgagatccatgtacataccatgaaatgcatattgtggggcatgcagatggaggtcattcattcccgggacaatcagacaattgttgaaatcttcacagggaatgccgtgaaactgctctggaagctgtggatagacaccgattgtcaggccattctggcagacgagataagcgtcttcaaggcaggtcagatgactggaatctgtactgaagcatacagcgcctctgagtgcaaatgtggttggcttttttgtcatatgagttacctccttttggctgttggaacttgtccgcaggcaaaaaaaataccgaatatttttgcccgacgagttactgtgaccagtaacacttataggcaactattacggtagttggtagagacgtccaaccaattatggacctatataagctttgtggtgttgtttataaaataattataaaataggaatagttttctgtcaaatacaaattcataacttacatggagaatattgcgtgaaaaatttgtacaaaatgttgcaggataccatgagcaggcggataaaaattccggcggcctgaaaatcagactgccggaatataagaatgcaattatttattatttttgtttttctctacttccagtaatttcatagcacgaactttgagcggaagaccaaagagggtgatgaatccgtctgcatcatggtgatcatacatatcacctgttgtaaaggatgcaagagattcgttgtacaggctgtatggagaagttgtaccggctttgatgatgtttcctttgtaaagtttgaatttaacttcaccggttacatatttctgtgtggattctacgaatgcctggattgcttcgcgaagtggtgtgaaccattttccttcgtatacaacctgagcaaactggctgccgagtttcttcttggcttccattgtgtcacggtcaaggatcagttcttccaattgttcgtgagctgccatcagaattgttccgccaggagtttcgtatacaccacgggatttcatgccaacaacacggttttctacgatatcaatgataccgattccgttttcgccgccaagacggttcagttcagtgatgatctcggaaaccttcattgcttttccgttgagagttttcggaacaccttcttcgaaagtcatagttacttctgtttctttatctggcgctttttcaggagttacacttaaaacaagcatgtcatcatagtttggagcctgggaaggatcttccagttccagaccttcatggctgatgtgccataagttacggtcacggctataactgtggcttgcatcaaacggaagattgattccatgagcctgacagaatgcgatctcatcttcacgggactgcatggtccatacgtctgtcattctccaaggagcgatgatcttgatatccggcgcaagtgctttgataccaagttcgaaacgaatctggtcattacctttaccggttgcaccatggcagatagcaacagcgttttctttacgtgcaatttcaacaagtttcttggcaattgccggacgtgccatagaggtaccaagcagatatttatgttcgtatacagcacctgcctgtacacaaggcattacataattgtcacagaaatcatcaacaatatcttcaatatataatttggaagctccggaaagtttggctctttcatccagtccatccaattcgttaccctgtccgcagtttacgcagcagcagataacttcataatcaaaggtttctttcagccacggaatcagtgctgtggtatcaagaccgcctgaataagcaagtacaactttttctttcataatgtgatcctcctgaaaatgattttctgccacttggcagatacatgaatatttgatattataaaaggtaaagattcatacgctgatttgataaagtgttgaatcttcatgctatgtcgggcttcgacaaaagataatatacaacaatttttataaatatgcaataccaatatgcaaaaaagttaaagatttttttgcataaaaatgcacatttaaataggaagaaaccaataaaaatacataaattcaagaaaaaagaatgtaaaatccataaaaattacgtattgcatattatgcataaaagatgtataattgttacatcttatgagagaacattccgatttcaggaggagagaaaaatgatcaaagcaggaattatcggagcgactggttatgcaggaaatgaacttgcaagactgctccttggacataaagaagtagaagtggcatggtatggttcaagaagctatattgatcagaaatatgcagatgtttatcagaactttttcaaactggtagatgcaaaatgtatggatgacaatatggctgcacttgcggatgaggtagatgtgatttttactgcaacaccacaggggctttgtgcatctcttgtaaatgaagagatcctttccaaagccaaggtgattgatctgagtgcggatttccgtattaaagatgtaaagaaatatgaaaaatggtatggcatcgagcacaaagctccacagtttattgatgaggctgtttacggattgtgtgagatcaatcgtgaggatattaagaaagcaagactgatcgctaatccgggatgctatccgacatgttcgacattatcaatctatccacttctcaaagaaggactgatcgatccgaatacgatcatcattgatgcaaaatccggtacatcaggagcaggaaggggggcaaaggttccgaacctttactgtgaagtaaatgagaacatcaaggcgtatggtgtagcgactcaccgtcatacaccggagatcgaggatcagctgggatatgcatgcggtcaggaggttctgatcaattttacgccacatctgattccgatgaacagaggaattctggtgaccgcatatgcttctctgaagaaagaagtttcctatgaagaagtaagggccgcttatgataaatattatgcagatgaaacattcatccgtgttctggacaaggatgtatgcccgcagacaaaatgtgtagagggcagcaactacgtagatgtcaacttcaagattgacctgagaaccagacgtgtcattatgatgggtgcgatcgacaatcttgtaaaaggtgcagcaggacaggctgtacagaatatgaacctgatgttcggtttcaatgaagcggaaggtcttcatcagattccgatgcttccgtaaagaaacaagaacacagggatattccatatgacgaggaggaatatattatgaagatcattacaggtggagttacagcagcaaaaggttttcaggcagcatccacagctgcgggaatcaaatatcagggaagaactgatatggcaatggtatatagtgagaaaccgtgtgtggcagcaggtacttttacgacaaatattgtgaaggcagcaccggtaaaatgggatcaggagattgtttatcagcatccgagtgcccaggtgatcatctgtaacagtggtattgccaatgcatgtaccggtgaagagggattcagttactgccgggccactgcaaaagcagcagcggaaactttgaatgtggatgaaaacagtgtactggtagcatctacaggtgttatcggtatgcagattccaatccagaaactggcggatggtgtcaaagcaatggcaccgaagcttcagggaactctggaagctggaaatgaagcggcaaaagcaatcatgactacagatacaaaggaaaaagaagttgcagtacagattgaagtcggtggaaagacagttaccattggcggcatgtgcaaaggttccggaatgatccatccaaatatgtgtaccatgcttgggtttgtcactacagatgcgtgcatttccaaacagcttctgcaggaagcattaagccaggatgttaaggatacgtataacatggtatccgttgatggtgatacttctacaaatgatactgttcttttacttgcaaatggaatggcggagaatccggagatcaatgagaagaatgaagattatcagaaattctgcgaggctttgaactatatcaataccacacttgcaaagaaaattgccggtgacggtgagggagcaactgcactgtttgaggtcaggatcattggagcagagagtaaggaacaggcagtaactttaagtaaatccatcgttacttcttctcttacaaaggctgcaatctatggacatgatgcaaactggggaagaattctctgtgcaatgggatattcaggcgcacagtttgatccggaaaaagtagacctgtattttgaaagtaaagcaggtaagattcagatcattgaaaatggtgtggcagttgattacagtgaagaagaagcaaccaagatcctttctgaagatgcagtgacggcaatcgctgatgtaaagatgggggactgtacagcaactgcatggggctgtgaccttacttatgattatattaagatcaatgcggattacaggtcataacaggttttagaatatataatgaggagaaataaaaatggtaaatcagaaatatctggacaaggccgagactcttattgaggctcttccttatatacagcgttttaatcgtaagatcgtagtagtaaaatatggtggaagtgccatgctggatgaagaactgaaggcaaatgtcattaaagatgttgttcttctgaaactgatcggattcaaaccgatcatcgttcatggcggtggtaaggaaattagccgctgggtgaacaaagtcggcatggaaccgcgttttatcaatggccttcgcgtaacagacaaggataccatggaaattgcagaaatggttcttgcaaaggtaaataaagaactggttactctggtggaatctcttggtgtgcaggcagtcggtatcagcggaaaagacggtggactgcttcagtgccacaagaaactttccaatggagaggatattggatatgttggtgatatcgaaaaagtaaatccgaaggttctgcaggatcttctggaaagagatttccttccgatcgtatttccgattggttatgacacaaactttgattcttataatatcaatgcagatgatgcagcatgtgcgatcgcagaagcagtacatgcagaaaaacttgtattcctctctgatattgaaggggtatacaaagacaaagatgatccgaacacactgatttctgagctgcatgtacatgaagcagaaaaactgatcagcgaaggttatgtaggaggcggaatgattccgaaactgcagaattgtatcgatgcgatcgaagaaggggtaaacagagtacatattctggatggacgcattccacacagccttcttctggaaatctttacaaataaaggtatcggtactgctattttgagagaggacggggagaaatactacgatgagcatgaatgaacagatgaatcatgcagaagaaagcattctgcatacatataaccgttttccggtcatgtttgaccatggagagggatgctacctctatgacacagaaggcaaaaaatatcttgattttgctgccggaattgcagtaaatgcactgggatatcattatccgggatatgatgacgcactcaagagtcagatcgacaagctgacacatatttcaaatctctattacaatgaaccaatgagtgaagcgggagagaaactgatcaaagccagtggactcagtaaagcattctttacaaacagtggtacagaggcaattgagggcgctctcaaggctgcacgtaaatattcttataccaaatatggcaaagaagcaggaagatttgagattatcgcgatgaatcattccttccatggcagaagcatgggagctctttctgtaacaggaacagaacattacagagagccatttgaaccactgatcggcggtgtgaagtttgcagacttcaatgatctggagagtgtgaaggcacagattacagataaaacctgtgcagtcattacagaagtcgtacagggtgaaggaggaatttatccggctcagaaggaattcctggagggtcttcgcgcactttgcgacgaaaaggacattattctgatctttgatgagattcagtgcggcatgggacgaactggatattattttgcatggcagtcttatggtgtacagccagacgtgatgacgtgcgccaaagcacttgggtgcggtgctccggttggagctttcgttcttggtgaaaaagcagcagcagcgtctctggtgccgggagaccatggtacaacttatggtggaaatcctttcgtatgtgcagcagtcagcaaggtatttgatatctttgaacaggataacattcttgcacatgtgcaggaacttacaccatatcttgaggaaaaactggatgcacttgtggataaatgcccgattgttgcagcgcgtcgtggaaaaggttttatgcagggactggtgatcgaaggtacgacagttggaagtgttgtaacaaaagcacttgcgaatggacttcttgtgatctcggcagggagtgatgtgcttcgcctcgttcctccgcttgttatcacaaaagaacatatcgatgaaatgatcgagaaattagaaaagagcctggcttaatgccgggctcttgcctgttctgaaaaattcttaaattctgtacaattctgtaccattcacttcataatgattatttcatactgtcgagatcaatatgtttcttgatcgctgcaaaactttcgctgctgatcacatgttcgatcttgcatgcatcgcttgctgcaacaaccggattaacgccaagcttctcaagccactcggaaaggaaaagatgacgctcgtagattttctctgcggtagcaagaccggattctgtcagataaagatatccttccggagatacagtgatctgatctgtctcgcggagcttcttcattgcgacgctgacgctggattttttgaaaccaagctcagcggcaacatctacagaacgcacgacaggatgtgacttgcttaagataagaattgtttcaagatagttttcggcggattcgtttgtatgcatccattacaccccaatttctgttcatgatctaatggaaaatgatttctcatttctcatttaattgctttaaaatttaagattttcactcaaatttatagtatttctataatatcatattttatagccagggacaacaaaaatgcataaatacacttataaataattgtataaaagttactgtgaacagtaacatataaaaccgataaaattcagagatgcagaagttccttgagccaaacattggttatatactacaaatataagtttgaaataacggattgaagttatacataacaaatgatagttttattaaacgaaaaaaagtacttgacagctcacaaacgttagcatatactaacccatgtaagaaaaagtaaatggtgtttaactgtgaactttttttgataaagaaaataattctcaataaagactataaaagaaagtgagctgatacatatgatgcctatcacaatggctggaatcggagaaaaatgtaagattcagaaaataggtggaaacgaagaaacaagacgttttctggcgaatcttggatttgtcaatgaggctgaagtaagtatcgtttctgcaatcggcggaaatgtgatcgtgaacatcaaagatgcacgtgtagcagttaattcagatatggcaaagcacatatttatataaattttataacggaaaggagacagaacgatgactttaggtgatgcaaaagttggaagtaccgttgttgtaacaaagattgaaggagacagcgcgtacaaacgtcgtatcatggacatgggaatcacaaaaggaagcgaactgtatatcagaaaagttgctccgcttggagatcctgtagagatcactgttagaggttatgagttatctgtaagaaagaacgatgctcagtgcgtacaggtaaagtaagtacgctgtagtgttctgtaagaactattatgaaaaatgcaactgtggagaagaacgcagttacaataagagggattaaggaggtaagaaaaaatggcaattaagattgcacttgccggcaacccgaactgtggtaaaacaacaatgttcaacgcattaacgggcgctaaccagtacgtaggaaactggccgggagttactgtagagaaaaaagaaggtaaattaaagggaaagaaaggaaagggcgaagacattatcgtaacggaccttcctggtatttattccctttcaccatacacactggaagaagtagtcagccgtgactatgtcctcaaagagaatccagatgtgatcattgaccttgtcgatgcaacaaatatcgagcgtaacctgtatctgaccactcagctgatcgagacaggtgttccggttgttattgcactgaacatggctgatcttcttgaaaaaagaggaatcaagattgacaccaagcgtctttccatgctgcttgactgcccgatcattgagacatctgcgctgaaaggggaaggccttgacaaactgatcgacgaggctgtcaaagttgcaaagagcagcaaagttgatcttccaaaagaaatcttctccaaagatatggaagcagctatcgacgaagtaaaaggtgttcttcctacatctgttacagatgataagaagagatggtatgcggttaagttccttgagaatgatgaaaaagtaaaagaggctatgaagctttctgcttccggacagtctctggttgatacaaaacgtcaggaacttgaaaaacagcatgacgatgacatggaaagtatcgtaacagacgaaagatacaaattcatccagaagatcgttaatacgacggttaaaaaagcaaaagataaactgactgtatccgataagatcgaccgtatcgttaccaaccgtattcttggtatcccgatctttgttgcagttatgtggcttgtatattatgtgtccgtaacaacagtcggaacattcgtaacagactggacaaatgatgtatttgtagtagctattcaggacttctttacaaacatccttaccagcatcggtgccggtgacctggtaatgggacttgtagttgatggtatcatcggtggtcttggtgcagtacttggattcgttcctcagatggcaattctgttcctgttcctgtccatccttgaagactgtggttacatggtacgtattgcattcgttatggaccgtgtattccgtcacttcggactttccggtaagagcttcattccgcttctgatttcttcaggatgcggtatccctggaatcatggcttccaagaccatcgaacaggacaatgacagacgtcttactattatgacagcaacatttattccttgtggtgccaaacttccggttatcgctcttatgggtggtgtaatcgctggtgaaactgcaggatatgcagagagctcctttatcgctcctctgatgtacttcatcggaatcgtagctgtacttgtagcagcaatcattcttaagaagacaaaaccgttctccggtaaaccggctccgttcgtaatggagcttccacagtatcatattccgcaggttaaaacagttctccttcatgtatgggaaaggctgaaaggcttcatcatcaaagctggtacaatcctgttccttgcttgcgtagtaatgtggttccttggtggatttggattcacagatggtggattcggtatggtagaagacagcgcagacagccttatggcagcaatcggtggtgtgatcgctccgatctttgctccacttggattcggtgaatggcagccggtagcagcttctatctccggttttacagcaaaagaagctatcgtatctacaatgggtgtcctggctaacgtagctggtgatacagaagatgcagtaaacgttgcagcaggtgttgcaagctggttcccgacaggaatcgcagctttctccttcctgatgttcaaccttcttgattctccttgccttgcagctattgcaactatggcaaaagaaatgaacgacagaaaatggttctggttcgcaattcttttccagaacatctttgcttacgttgtttgcctctgcttctatcagattggttcctttgtaactggtggagcattcggtttcggaactgtagtaggattcgtagtacttattgtaatgctgttcctgctgttcagaccggatccgtacaaagatcagaaagtttattctaaacgttctgtacaggcataataaaaaatgtaataataagggggctggatacagagatgtgtccggcctctgtttgattcgaaaccgatgactggcagtacttgatgaagagaggatgagtgaaatgctggcaaatattattataatgattctgatccttggatattgtgcatttatcatttataaaagtgtaaagaataccaaagaaggtaaacatacggggtgtgccggatgcagtggaaactgcggaagctgcggtggatgcagcggggcagcttttcataagaacactgcgcagtcttctaagaatcgtttgaaataggaggcactaatatgggaaattcaacaggatccacaatgtacatgtttggtgcggtcattgttatttatattgtaggaatgctgatctatcagggggttcagtggatcaagaaaaagagggaacagaaaaaagacgaagaattcagaagaggtgacaaatagtggtagatataattatagtactgatcgtaattgttttgcttgggtttgcactgaaaggttctatcaaacattttaaaggagaaagcccatgctgtggaggcggcggtggagagatcgttctcgatattccggataaaaaacttgagaatccgatacttggaaagaaggttctcaaaatttccggtatgcactgcgaacattgcgtaaaggctgtcacagaggcaatcaataagatcgatggagcagctgcaaaagtaaatctttctgagaacgaagcagtcgtttcttatgatcgcgaacttgatgacgaacagcttagaaaaatcgtcaaggatgcaggttacagagtcgtaagcatcaaataatgcatgatatagtgaaagaaatatcatttccaggatcccgtggcatatgaagctgcgggatttttttctgcgaaaattatagaattttatatgtgattttttgaagtggttccttgtataaaaaacagattttctgcatatgctgataataaaatttgcagctaggtataggaaaagcatctgagctgagtggaggttgcattatgtggggattttttacggcattgatctcgggagcgctgatgagtattcagggtgtttttaatacagaagtgacgaaacagaccagtttatgggtatcaacgggatgggtgcagctctcagcatttatggtctgcgtgctggcatggatatttacaggaagacagagtgtttcggcattatggcaggtagataataaatacacgcttcttggcggagtgatcggggcatttattacaattactgttattcagagcatgggggcacttgggcctgcaaaagcagctatgctgatcgtcatttcccagttgatcgtggcgtatgtaattgaacttttgggaatgtttggaacaatgcagcaaccgtttgagtggagaaagattctgggaatgctgatcgcgattgccggcattgtgatttttaaatgggaataataaagttatcatgcacaggaataaataaagtttcctattgtaaatctaccgggaattcgttaaaataagacatggttaagtatgagaatcggggaggtctgccgtaatcctacggagggaagtgaaccgagatcatgaaagtaaatttttacagtctgatattgagcatattttttctggcaggtttgtcaggaatgagcggatgtcagaaaaacaaaacagaaataatgctggacggacaggatactgtatcagaatcagaaacacaggatgatacacaggctgggaatgatgcaacagaggatctggcggaagcaaaaatatcagcagaagcggagctatcggagatgccggtggagacagagccggaaatgatttttgtggatgtctgcggagcagtaacgaatccgggagtttacgaactggatgggagcagtcggatttttcaggcaatagaggcagctggtggatttttgccggaagcagcggcttcggccgtgaatcaggcacagccggtcagtgacggacagcagatttatgtacctacgcaggaagaagcggaagagggagctttacctgcggcaatacagccggcggatccgggatctgagacaacagatgcaaatggtgtagtgaatatcaacacagcagatgcagctgcgcttaagagcctgtcaggaatcggtgatgccaaggcacaggcaattcttacgtacagagaggaacatggttccttttccagtattgaggagatcatgcaggtgccgggaatcaaagaaagtacgttttcggcgataaaggataaaatagctgtgaaataaggagaaaagaatgagcaggaaagttttagtagttgatgacgagaaactgatcgtaaaaggaatccgttttaatctggaacaggacggtatggaagttgactgtgcttatgacggagaagaagcggttgagaaggcaaaggagaataaatacgatattatccttctggacctgatgcttccgaagatggatggactggaagtctgccagcagatcagagaattctccaatgttccgatcgtcatgcttactgcaaaaggtgaggacatggacaagatccttggactggactacggggcagatgactatattacaaaaccatttaatattcttgaagtaaaggccagaatcaaagcaatcatgcgtcgtgcgcgttctgaacatgaagaaaaggaaaaggcgaagacaattgaagcaggcgatctgaaactggactgcgagagccgccgtgtatttattgcaggcaaggaaattaatcttacagcaaaggaatttgatgtgctggagcttctcgtattcaatccgaacaaggtatacagtcgtgaaaatcttctgaatattgtctggggatatgaatatccgggagatgtcagaaccgttgatgtacatattcggcgtcttcgtgaaaaaatcgaggctaatcccagtgagcctaaatatgtacacaccaaatggggcgtaggatattacttccaggcataacccatggtaacgaaaaaaaagacaaagttttttaagagtctgcgttttcggatactggtcatactgctcatactgggaattgtgccaagtgttatcgtgacacaactcatgatcagtaattatgaaaaacaggcaattgaagtaaaggtaagtgaggtcagtacacagtgtgcgattctgtgtaatcagatcatcaaagaaaattatctcaatgactccagctcacagtctgtgaacagcaagctggagttgttgtctaatgtatatggcggaagaatggtgattgtagacagagatctgaaagtagttgcagatacctatcatgtagatgaaggacggacgctgatctcaccaaaggtcgtgaagtgttttaagaacggagaagtgacaaattaccgcagatacgggcagatgctggaaatggctgttcccgtaaagagcgcggatgtcccgcagattcagggagccatgcttgtaaatatttcaatcagtgacattatggcaacggtgggagagcaggaacagatggcgatgctgctcacaggaattatcgttgcattgtctgtattgcttgcctatggcctttctacgattctggtcaaaccgctggccagtgttaccaaatccatcgaagatcttactgacggatatcagaaagatgagatttcagttccggattatacagaaacagagcttattacggatgcattcaataagatgcttgcacgtatgaaagtactggatgaatcaagatcagagtttgtttccaatgtgtcgcatgaactgaagacaccaatgacttccatgaaggttctggcagattcccttgtcggacagaaaggagttccggaagaactttatcaggaatttatgcgtgacattacagcggagattgacagggaaaaccgtattattaccgatcttctgactctggtaaaaatggacaagaaatctgcagatcttcagatcagtcatatggatatcaatcagcttctggaggatattctcaaacgtctgcgtccgatcgcggacaaacgcaatattgacctgattcttgacagtttccgtcctgtggaagcggatgtggatgaactgaaatttacatctgcgatcagtaaccttgttgaaaatgcgataaaatacaatgtggatgatggctgggtacgtgtgtcacttgacgcagatcataagtttttctatgttacggtagcagattctggtatgggtatcccagaggattccatcgaccgtattttcgagagattttatcgtgtggacaaatcacattccagagagatcggaggaaccggtcttggacttgcgataacaagaagtacgattgccatgcatcatggtgtgatcaaagtattcagcagagaaggggaaggaactacattctcagttcgtgtcccgttatcttatattccgtaggaggtgccggatgaagaaatatataagagtacttcttctggcagcactggtttgcagtttacttgccggatgcagtattgagacaaaaagcagtaaggattcgcaggatgagagtaagtactatctgtattatctgaacgagagtgagacggttctcagagaagaaccatattcacccggagaagagacggcagattttatggtaaaagatcttatgcagaaacttggaagcaaagatgcaccggatggggaaatcagtcttcttccggaagatgtttccatcaattcttatgaagtgcagaaagatctgcttgttatagacttcagtaaagaatactcaaaaatgagcaagatccgagaggttatgacacgtgacggagttgtgcagacatttttgcagattccggatattcataaagtccagtttacagttggaggtcagccactgaccaactcgcgaaatcaggaagttggagagatgacttcagatacatttgcgcaatataccggaaaagacaaagaaagctatcgttatgatacttttacactgtattttacgggtaaaaatggaaaaaatctggtgaaagaaaccagaaatgtatattatcgaagatctcttccaaaagaacgtatcgtgcttgagcagcttgcaaagggaccgatggaagaagggcattatgcaacgataccagacagttctctggttttgagcgtgatcacatcggacaggatctgttatattaacatgaacagcacttttcgtgatgaaacaccggaagtaggaggaaatatctctatttattcggttgtgaattctattatagattcctgtgatgttgacagggttcagatatctattgaaggcagtacggaggggaacttccaggacagtctgccgttatacaaattttatgaaaagaatgaagatttaattgcacaggacgagaaaccaaaggagtcctgatgcagtaatgccgcaggtggaatagcctgcggtgttctatatacagaaaggaaggcttatgaaaagacgcccggtgtgtcttgtgtgcctgctcctgatgttgtgtatatggttgatggatctggcgggatttgcacggatcagtggaaatcctttgccggaatctgtacaattatatattgaaaaacatccggaagctgtcatctgcggggaggtgcagcaatatcaggctacggaatattctctttctgcctatcttaaacatgtctgtctgatcgtcggatcagaacaaattcccataaaaaatttaagagtatttttaaaatcgaataaagagttcccgattggaaccactgttaagatttcgggaaaactggaagaaattcctgagccacgaaatcctggagaatttgattccaggcaattctacgcctgtcagaaaatctactattttatgaaaaacggtgtggttctggcatggagcagcaaatattccagatatggtcagtttatgcagaatctgaaaagtaagataatgcagacgctggatattgcggcaaaggaagatgccggtatttttgaagcaatgctgcttggtgagaaagataacctagaagataaagttaagattcgttaccagatggcggggatcattcatatactagcgatttccggacttcacatcagtgtactggggattggattttttgatctgctgaaaagagccggatttggaaatgtgtctgccgggatggtggtgctcagtgttcttctgcaatatggaatccttaccggggaaagtgtttctgccatgcgggcggtaggtatgtttctgttggcggtcggtgcaagaatcgcaggaagaacctatgatctgctgacggcgctggcagtgtcggcgatccttttacttctggatgcacctgcaaatctgtacaacagtggattttggctgtcgtttggggctgttgccggacttggtgtagtggcaccggtattggcaggatgcattagagtggagaatcgtctggaggcatccgttatgaaaacactggtatcttcgatagctgtgcagatgacgacttttccgatcatgctgcgaatctatggagagatttcactggccggattttttttgaacctgctggtgctgccgacagtcagtgtagtactggtcagtggaattgcagcaattgtggttggaatggcatcggtcggtgtagcagtttatgtagtgctgcctggaagagtgctgctttttctgtatgagaaactctgcgaactggcagcaggaattccgttctgtacatggatcgcaggaagtccggagctgtggcaatgtgccggatattatgtattactgtttttgggagttggaattttgggaatgagtcggggaactgtcgcatggaatggcgcaactggaaaaagggcgggaaatcatgcattcatgcaggaaaaaaagaatcatggggaaggaaaaggatggctgagaaaatatcagttactgtcaggtatatcaggaatcatgctgatacttggactgggaattctcatttatcatccgtctggaaatctgcagatcacctgtcttgatatcggacagggagactgtatttctattcagcttccacaggggcagaatttcctgatcgatggcggcagcagtaacaagaagaatattgcacactatcagattctgccattccttaaaaatcggggtattggggtgattgatgctattttgatctcgcatacggataatgaccatatcagtggtgtgctggaactgtttgattatatgaggacacatcttacttctgtcagggtgaagaacctgatcttaccggaatggacacaaccggacgatgcatatcagcaattggtggataaagcgcaggcagcaggcgtgaatgtacaaaagggaagaaaaggggaacaaattgcgcttggaaaagcttctcttcgattcctttcgccggatagagggaccgcaggaacagatgcgaatgaagacggtatggtcgtggaactgacatatggcggttttgaagggctgtttaccggtgatatcgggacagagacggagaaaaaacttctgccggagctggaagatgtagattttctgaaagtgggacatcatggctccagatattccacctgtcaggaatttctggatgtggtgagaccggaacttgcggtggtctcctgctctgcaacaaatacatatggacatccgtctggcgagacaatagaacggttggaagattccggggcaaagatttggtacacaatgaaagaaggggctgtgacagcagagaccgatggtaaggaggtatgggtggatacgtttgtgcatccgtgagcagagatacggtattgagaaaaaaatcaaaatcgtctatactaaacagataatgaataattaatgctgtctgtggatggcattccgtcagaaaacggtatttttcaggaggtttcgcaggaagtgaaaaatttacaggaagacattaaaacaggaaaattcaaaaatgcatatcttctgtttggtgaggaagcgtatctgaagattcagtacaaagaaaagctgattcatgcattaaatccggatgatgatacgatgaattttaccaaatatgaaggaaaaggaattgaggtgcgtgaaatgattgacctctgtgagacaatgcctttctttgcagatcatcgtgtggtccttgtggaaaattccggattttttaagaataaatgtgatgaacttgcagattatatgaagacgctgccggattacctgaggctggtttttgttgaagaagaggtagataaacgaagccgtatgtataaggcggtgaaaaactgcggccgcattgtagagtttgcaaagcaggatgaaaagacactgatgcgctgggcagcaggtattctggcgagagaaggacgcaagatcacgaccagagatatggaactttttctgacaaaaaccggtacggatatgggaaatatctgtatggaactggagaagctgatcacatataccatgggacaggatattgtaacgagagaagatattgaggaaatctgtacaacacggacagagaataagatcttcgatatggttcgtgcagttacggagcgaaatcagaggagagcactggatctgtataatgatcttctgacgctgcgtgagccgccgatgaggatactgttcctgctgtcgaagcaattccggcagatgtgccttgcaaagaaaatggcaggggaaggggcatctcagaacgaaattgcaaccagacttggcgtaccgtcttttgtggcaagaaatatactggcctgtgcgagagcttacagtgttgaggagcttgaacaggcagaagaggattttgttgatgcggaggaggcagtgaagaccggaagactgcaggatgtgctgagtgtggaactgttgatagtgaaatatagtactgagagaaaaagataaaagtgtaacagatgtgagtaaatatagtacccggaaacggcttcatcgtccggttgtactagaatataacctggctgttaagaacgtcaaaatcgtcagcaaactcgctacgctcagacagagtttccgattttgccaacacagcccgaacatattcaagtacaacgacgaacgattgcagatgtttccgggtactatatttatccatctgttttcgcttttatttaatttttctcccgggaaggggcgaaggcacggatagtgcaagaatttctttacaccaatatacataggtgtcttgacacctaacatgtcgggtagtataatcacaaatcagaaaacataaaaatacaaaacccaacagaaaatccggcatcaaccggtacgaggaaacaaaaatgaaagaaaattacgatgtcattatcgtaggaacaggagccgcaggtctctactgtgcactgaatctgccttccagaatgaaagtactgatgctgaccaaacagcaggcggatcagtccgactcctttctggcacagggcggtatctgcatgctcagaggagaagaagattataatgattactttgaagataccatgcgcgcgggccattacgaaaatgacgcaaaagcagtcgagctgatgatccgtagctctaacagtattattcgagatcttttacagagaaatgttacatttgaacgaacagagacgggagaattggatttcactagagaaggagcacattctcagccgagaatccttttctatgaagatattaccggtaaacagatcacacagactcttctgaatcaggcactgacaagagacaatattgaaatctgcgaatatatgaccatggtcgatatcatttccaaagacaacgtctgtggcggggtaatcgtcatggatgagaagaatgaagtatatccggtcagagcaccatacgttgttctggcatgtggtggtctcggaggtctttacaaaaactccaccaacttcccgcatattgcaggcgatggacttggaatcgccatgaaacatcaggtggtactcgaacatctggattatatacagattcatccgactactctttattctcataaaccaggacgccgtttcctgatttctgaatctgtcagaggggaaggtgcacttttgtatgataaaaacggacagcgttttacaaatgaattgcagccgcgagatctgctcagccaggcaatctttgcacagatggaaaaagacggtactgatttcgtgtgggaagatatgcgtccactgggagaagaaaccatcatgaaacattttccaaatatttttcacagatgtgtagaagaaggttttgatccgcgcaaagagccgattccggtcgttccggcacagcactatttcatgggtggaatcaaggttgaccttggaagccgtacttccatgaaggggctgtatgcctgcggtgagacaagctgtaatggtgtgcacggcaaaaaccgtcttgcaagcaactcacttcttgaatctctggtctttgcaagacgcgctgcagatgatatcatatttggaagaaaaccagatccgtgcagaccgggtagcatagatctgaaaccatatgaggacagagacgcagttctgactgtttatcatgaaatggttttaaatgaaattgaaaggatgaagaagagtcatgaatgaaattacaatgaaaatgcaggctgatcagctgatccgtatggcgttgcaggaagatattacaagcgaggatgtttctacaaatgcggttatgccgacagcaacaaaaggaaccgtagagcttatcgcaaaagaagatggtgtaattgccggacttgacatttatgcgagagtatttacaatcctggatgaaaaaacagagattgatttttattgcaaagatggagatgaagtaaaaaaaggtgagctgatggcaactgtaaccggtgatattcgtgtccttctttccggagagagagtagccctgaattatctgcagagaatgagtggaattgccacatataccagacaggttgcaaaacttctggaaggcagcaaggtaactttactggatacccgtaagacaaccccgaactgccgagtatttgaaaaatatgcagtaagagttggaggcggatgtaatcacagatataatctttcagatggagttttactgaaagataaccacatcggggcagccggaagcgtaaccaaagcgatacagatggcaaaagcgtatgcgccgtttgtccgaaagattgagattgaagtagagacactggaacaggtaaaagaggctgtagaagctggtgcggatatcatcatgctggataatatgacaccggaagtgatgaaacaggcagttgagctgatcgatggcagagcacagaccgaatgctctggtaatattacaaaagaaaatattcagaagatccgtgagatcggtgttgattttgtttccagcggagctttgacacactctgcaccaatccttgacatttccatgaaaaaccttcatgcggtgtgagaggaggaaaccttatgaacactgcagaaagacgcggagaaattttaaagatccttcataatgcagatgctccggtggcagcaagagagcttgcgggaaaatttggtgtcagccgtcaggtgatcgtgcaggatctggcggtgataagggcttctacgccgggaatattgtcaacaacaaaggggtatgtgattcagcaggacagtagctgcacacgggaatttaaagtccgtcacagccaggataaggcagccgaagaactgaatctgatcgtagactgtggtggacatgtcaaaaatatcagtatcagtcacagagtttatggtcgtgtcagcgcggagatggatattcgttccagacaggatgtgagtgagtttgtgcaggcattgcagaacagtcgttccactgttttaagtaatgcaacttccggatatcattatcatctggtggaagccgcaagtgaagaacggttggatctgattgaagaacagttgaagaaagccggttttctggctccgcttcagccatgggaacagagcacaggaaagggaaatattaaattatgacaatacaggaaattcagcaggagatcctgcgaatgaaaaaagaacaggatgtatgtattctggcacatgcttaccagggacaggaaatactggaagttgcagactatatgggcgattcttatggactgagcgtgcaggcatccaagagtaactgtaaaggtgttatcatgtgtggcgttcgttttatggcagagacctgtaaggttttaagcccggagaagaaagtgtggcttgccaatccgacagccggatgtccaatggcagaacagctggatctggagagcctgcgtaagttaaaagcagagcatccgggatatgcggtagttgcttatatcaatacgacttctgaactaaagacagagtgtgatgtctgcgtgacatcttcttctgcagtacagatctgcagtaaactggataatgacaagattctgtttatcccggatccgaacctgggacgttttgttgcagagaaacttccggaaaaagagtttgccttctacaaaggtggatgtccaagacatattatcgtcagcgcccaagatgtagaaaaagcaaagaaagcacatccggatgcattgcttctggttcatccggaatgccgtcaggaagtcgtagaacttgctgattatgttggttctacaaccggaatcatggaatatgcaaagaaatctccgaataaagaattcatcatcggaacagagaacagtattgtggaacatctccagtttgcatgtccggacaaacagttttatccgctgtctgtcatgctgacctgtatgaacatgaagatcacaacactgatggatatttacaattgcctgaagggaaccggcggagaagtgatcgaacttccggaaaatgttatggaaggcgccggacgctgcattcaccgtatggtagaactcggagggtgaatataataaataaagaaaaagttgagctgctggaaaggatattttcagcagcttgttttatactcgagtttataaaaagtttcgttgaccagatagtaggtttttgttaagcttagaacataaagaactatagtgaaaaggagggtacagaaaaaatatttacctgtacagaagataaaattttctggatgaaacagaaagtgaaaaatacattccgataattcctttaagaaacagtattcagagaaggacagttagatcaaagaacaatatctgaaactatataaaactaataatacgaatggaggacgttatcgaaatggaaaatacacctacagtcccgaataatgagctggaacagcgttacataaggtataaagatgtaataaaagagcttacaatcatgaatgatatctttatgcggaatgtatttaagaagcgtgaatgtatagaacatgtcctgcgtatcataatggaaatgaaaaatctgcaggtattggattatactgtccagaaggattataagaatttacaggggagatctgcaatccttgactgtgtggcgcgggatgatgtaaataaccaatataatgtagaaatccaacaggatacagaaggagcgtcaccgaaaagagcaagatatcacagtggattactggatatgaatactttaaatccagggcagaattttgaggaattgacagacagttatgtgatctttatcacaaaagatgatgtgcggggaaatggattgccgatttatcatgcagatcgagtgattgaagagaccggaggaatgtttggagatggatcgcatattatatacgtgaattcttcgattcaggacgaagacacagctctagggcgattgatgcatgatttgcattgtaagaatgccaatgatatgtacagtgaggttttagcaaagcgggtatctgaattaaaagagacagaaacggaggaaagtgttagtatgtgcgatgcgttagagaaacttattcaagaatttgagcagaaaggcgaattacagggcgaagcacgtggaatagcaaagggcgcaataaaaaaggcgaaagagactgcgaaagcacttagccaggaaggcatgccagtacagaagattgctcagattcttggagaagagggagaaatagtgaggaattggttagaggaagaaaaataactgattaattgctatttgacaggatgtcttcaaagtaaatgagaaaataggattctatcggaagattacagacagggtgatggaaataaatccgttatcctgtttgttttttgaaaattcgtcgctttatacaaaaaatagagaaaaatattgtctgatttagtggattgcatattggaatccgatatgatattatacatacatgaagaacgaagttcaaatatacagaacaacggagcttggattatcccttatccaagtttgaattcacccgatatatgagaacaaagttcaataatacagaacaaatacagcttaacatagagtggaaaggaggaagttatttttttaaacaagaacaaaaacattgtacattattaatgaacaaggagggcgagcagtaaactatgaaagcagcagtttttacaggaccttatgaattcaaaatctgtgatcgtgaaaaaccgaaaccgggtccgaaagaagtacttatccgtattcgtgcagttggaatctgtggctcagatattcatccatacatgggggatggaatagatcgaagagagcctggaatcattatgggacatgaagcctctggagatgttgaggaagttggttctgaagtaacgaaatggaaacctggcgacagagttgctattaatccacagatcaatgatgagacatgcccaatgtgtaagaaaggacttccacatctgtgtgatcattcacttctgattggatcatccatgagaggatttctggatggagcaatgtgcgaatacctgatcatgcatgaaaaacagctatatcatttgccagatgaagtaagttatgaccatggcacatttcttgatccacttggaaatgcgatacatctgatcaacaggggtggcgtaaaactcggagatgttgttgtgatcattggtgcaggaacgatcggtcttctggcaatccagacagcaaaacttgcaggagcagtcaacgtcattgcagtggatctttcagattataaactaggaattgcaaaagatgttggtgcagacatctgcctgaaatcagatgatccggaatttatggataagatcaaggctgagactcatggcacaggaccggatgtagttgtagaagctgttggaattggagttacttataatctggcactgaatatgtgcaaaaagagaggaacggttgttgctcttggctttacaaaaccggaactcgatattgcaattcagcagatcatatacaaagaactgaatgtatacggaagtacaggatatgcggatgaatgtgagacaacactggaattcctgaaaatgaaaaaagtagatatcgataaagttatcacacacaggctgccacttgaaaaagtaaaagaaggttttgacctgttatgtgataagaacagcggagcaatcaaagttattttaaacccataggaggtaatctatgaagaacagatggagaaaattagtagcaggtgggcttgcagcgtcaatgacggttatgatgggaaccagtggagtatatgcggcagataaagatgtggaaatcaaccttctgagtcacagatatgcggcgcttgagtattatgctcaggcaatgattgataatgcaccggaaaatgtcacagttaatacagaattaacaacatatggagactggcaggaaaagatgaccatgaacttatcatctaagtccagtgcatatgatatcacatatattttcccaccagatctggctacatttgcagataacggatggctgatgccattggatgattatattgaaaaatataatgacgtttataattttgatgatattccagattatctgtgggatgcatatacatatgatggacatatctatggtattccaagtcatcagtgggctgcattactttttgcaagagatgacgtattggatgaagctggattagaagtaccaaagactctggatgagctagtagatacagcagataaactgaatacagatgatatgtcaggtattactctttctctgaaagcatcagatatgcttgcaattaccttccagtgttttatgacagcctgcggtggatggtggtttgatgatgatatgaaaccaacatttaacagtccagaggcaatgaaagcagttgaatacattcagaaattaatgaatgattgtcctgatggcagtatgacatatggttctgatgaaactgcacttgcagtagcacagggactggcagcaatgggactgattcagacaacaagatcaggtgatatggacaatcctgagaaatctacagttgtgggcaaggttggattctacagctctccatcaattgaagagggtggagcacctgcttcgttgtatgcaacagctggttattcaatatctgcatttacagagcaggatccggatcttgtattccagacaatgtgtaatgcacttacagaagatgttatgaaagagggtgcatcaactggtatgccagtcagagaatcccttttgaatgatacattatttgcagaaagaccagattataaagctgcatgggaagcgattcaggttggtgcaaagatgagacctgcaattcctgagttctcagaaattatggaaatttccatgaccgcattatctgatgcattatctaatggaacagatgtacaggctgcaatggacaaagcagcagaagaatgtgaacagatactctctgatgcaggatactatgaataatcttatgaattagaataatgaattaaagtgaaaaagacaatacagtatagcctaaatgtaaaaacatctgcgtggtcatgacagcatggtggtgctgtattgtcttttttgaataatatttaaagaaagggttgaggtgatggatcgaaaaagtaaatacctgttatttgcattaccaagttttattttgatttttacagttatgctttttccggtaggctatgcgatcatatatagctttacggatttcagacttggtaagagtgcaaaatttatagggcttgaaaattatatcagtatattccaggattccgaatttctcagcgccctgggctttacacttatacttactttagttgcggtattaagtcagtttgtaataggaatgatattagcattacttttggataatattcatcactttaaaaaaccaatcagtattatgatctatattccttatttcataacagcagctgcaatgggtgttattttcagatggatgtttatgtcaaactggggaattattgatcagatatgccgcatgataggaataagtacatcaggatggttggattcaccgttctggtcacgtgtggtgattattctgggcgaagtatttcagaatacaccgttttcagtaattattttatatgcaggacttcagtcaatgccgttggatcagattgaagcagctaaaattgatggagccaataactggcagttatttaccaaaataaaacttccgaatctgagacagttaattattatcatttttatgatgaggacaatggacgcattcagattattcgacagagtaaatgtaacgacaggtggtggaccgggaatttcgacagaaactcttgcaatctataattatacaactacatttacaaaactcagagtaggaagaggatgtgcaattggtgttataacgttgatcattctggcggtgatcataaacgttataatgaaagttttgagagttaaggaggtggattgatgagagcgaaaaaaagaatgatcgtagtaatcagttatgtagttcttattcttgttgcactcatttcaatctttccgcttgtttacgcagttatgattgcaacaaaaaaaccggttgacgcattttccatgtcgtttaagtggatatatacacctatttttgataattttaaaaccctttggattgaaaaaggatttacaaaatatttgtacaatacagtagtagttaccggttgctgcgtattgatttcagtacctactgctacgttgggtgcatatggtcttatcagaaatggtggaaaatttgcgaccaggatcttaaattcgacattgttgttaaggatgtttccacagatgttgttggcgattccttattttataattgcaactaattttggactggcagatacaaaatttattctggttgtgattgtagtagcatccaatcagccatttgcattatggttgatgagaggatttctgataacgattcctcctgagttggacgaggccgcacgaatagacggttgtaatatggttcagacggttacaaaagttattttaccggttgctaaaccaggtatcgcaactgcatctatatttacattcttgctttcatataatgaatatttatttgcattgattcttactcaaaagaaagcgatgactcttccggtagctatcggacagtatggagcagaagatctttcttattggacattatcggcagcgggtgttgtaagcattgtcataccgatatgtattgtaatgatattccttcagaaatatctggtaaaaggaatggtagcaggagccgtaaaaggataagagaacatacttgatggaggaaaagatatgaatagtattacagtaaaagtattagaaaaaagatgcgaatataaagaaaatccattaggaattgataccccgaaaccaagattttcatggaaaatcaaagcactgaaaagggctgccggtcaggtggcatataatattcaggtctgggatgaaacaggaaagtgcatctgggataccggaaaatgtgagagtgataatactgtaaatgtacagtatgaaggtcagccactggaatcaagaaaagaatatcggtggactctgaaggtctgggacaaacagggagacgaatacgaaacagatgcggagaaatttgagactgcaattttagaagacagcgaatggaaagctgaatggattcggggcggtaaccttctgagaaaagagttttcagcagataagaaaattaaaaaatccagagtatatatatctggccttggttattatgagctttatattaatggagataagattgggaatcatgtacttgatccggcgtggacagactttgatcagaagatatattattctgtatatgacgttacagaaagtgtgaaaaagggaaaaaatgctgttggtgttatgcttggaaatggacgttattccccatatgagacaactattgcgaagaactggcatccattaaaaaaatatggagaatccccggtactgttttaccagcagtatgtatattatgaagatggaagtgaggatatcattgtatctgatctgtcatggaaagtatcggatggtccgattgtatttgatgatatttatgatggggaacgatatgatgcacgtcttgaaaaagatggatgggatatgcctgattatgctgacaaagactgggcagatgcctgcaaagtaagtgaaaagatgggcagactggtttctcagggaacatttcctgctgtaaaagtaatcaaaccgagaattccagtttctatgacccagccacaggcgggggtttacctgtatgactttggacagaattttgctggctgggtacatctgaccgtacagggaaagcctggcgatgttatttctgtacactatgcggagctgaaagatgaaaaaacaggaatgctttgtccgaatacaaacagaaatgcagaagcacttgatacgtatacatgcaaaggtgatggaacagaaatctttgagccacattttacatatcacggattcagatatattgaacttcgaggatatccgggaacaccatctatagatagcgtgcaggcaagagtggtacattcttcagtagaaagaattggaagcttcagctgcggaaatgaacttattaataaaatccattcaaattatgtgtggactcaggtaagtaatttgcatagtgttccgacagactgttgtcagcgagatgaaagaatgggatgggtcggagatgcacagatgtcagcagaagcagcagcttataattttgacatggcacagttttatagcaaatttgaaggtgatatcagagaatcacagcttgaaacgggaagcgtggctggtgtttctccggcatattggagctgttatccggcagatcctacttatgcaacagcgtgcgttgaatttccgtgggttgtaagcagatattatgatgatgatagaatcgttgaggaaagtcttgagacaatgacgaagtgggtagattaccttggaagtcaggaggatgaagatggtattgtttcatttggactctttggtgactggtgcccaccgatgcatgcaaatccggttgatacaccatttgagattacatctacatggtattattgtcatgatgctctgatggtatcacgtatggcagcaagaattggcaaagcagatgtagcaaagaaataccgtgaagtggcaaataaagtagcagacgcatttaacagacgtttccttaaagtagacagatattctgcatctaagttttctgatgaagaacttgcagaaaaaattaaatcttggctgaatgttcttccggaagatcagagaccggcagttatgaaacgatatgcaacattgtattcatccagtagccagactgcaaatctccttccgctctggttggatattacaccggagaaaaatgtaaaagatgtactggaaacactggtgcaggatttggaagttacgcgggcatggcacattaacactggcgtagtcggacttaagtttatgtttgatgttctgattaaatatggatatgaagatctggcatacagacttattacacagacttctttcccgtcatttggatatcagatcgaaaaagaaggcgctacaacactttgggaaagatgggaattcctcaataatgataaatgttttaactctcacagtcatccatttgcaggaagtgtagatgtatatttctataaaatacttgcaggtctgggattggacgaagaagtttctggatttaagaagattattctgaaaccgattatgtcaggagatcttccatatgcatcagcatcagtgaataccattcgtggtaaagtggtatcggcatgggagcgaaatgatgaagaactcagatataaagtagaagttccgggaaatacaacagcagagttgtacattccgaaaaatgcgtgggacaaaattgagatcaccgaaggaacaaagagctgttggaatggagaaaatgcagtagatgttgaaggaatgacttatttaagagaagaagaaaaatatgttgtttatcagattgaagccggcagttatgagtttaaagtggcaccagtgaaataaaggagggacaggctttgaagagaacgggaaaaaagctgcagggaatcattcctgctattgtaactccaattgatgaagatggaaaattaaatttgaaattgcttgaaaaacaggcgggatatttacttgacggaggtgttcagggactatttgcctgcggtggaacaggtgagggagcttatctgaaaacagaagagaaaagactggtattccatacattaaaacagatgctgccggaagataaatttctgtgtgctgccctgattaattcaaataccagagctgtggctgatgaaatcgcagctttgggagatctggaagcggattatatagtggcaactgcaccttattatcatgcagcgtcccaggcagatattctggaacattatatgacaattgcgaagaaatcacctgttccgctgatcgtatacaatattccgtctacaacccataattacatagaacctgaaacgatcaataagctgattgcagttaaaaatattgcaggagtaaaagattcatcaggaaattttatgaattatacaaggggattatttgagaatcagaataaagaatttgcatggatacagggagaagattatctttgcggggcaaactttcttgcaggggcagatggagttgtttcgggactgagcaatgtaagaattgaaccgtatgtggaaatgtatgaagcttttttgaataatgatgcgcggaaaataaaagaatgtcaggtcaaaatcaataagttatataagctgattcatttgtatggaaatggcaatgcatctattaaggctgcaacggaattatatggcagaggaagccggtggatgcagcaatccagtatgagtctggatgatacacagatggcagaaattaaaaagattctggatgaatacgagcgataggaggagcctatgagcaaaaacttcaacaatggtgtatggccggttatgctgacaccattcacagacgacaacagagtagactatgattctctggaaaaactgatcaactggtatattgagaatggcgttgcgggcctttttgcagactgccagtccagtgagatgttcttcctatcgctggaagagcgtgtagaacttgctcgttttattaaagaaaaagcagcaggaagagtaccggttgtggcttctggtcatatttcagatatgattgaagatcaggcagaagaactgaatgcagtagccgggacaggtgtcgatgcggtgattcttcttacaaaccgcctggcggcagaagaggaaagtgatgaagtatggcttgaaaatctgaaaaaactgcttgcactgcttccggaagacctggcactgggattttatgaatgcccgtatccatataagagagtaatttctccggaacttctggaatggtgcgcaaataccggaagattttatttcattaaggacacaagctgtgatatccacaatatggaagcaaaacttgcaaagatcaagggcagcaacctcaaactttttaatgcgaactcatctacgttattagaaactttgaagcttggaggaagcggattcagtggtgtaatggcaaacttccatgcagatctttatgtatggctgtgtgaaaactatgagaaagaaccagagaaagcaagaacggttgctgattttctgacaatagcttctatgattgaaagacaggtttatccggtgaatgcaaagttctatcagaagagcattggcaattttgcatcgatccatactcgtacgaagccagcagaactgttaaatgaaactgctcgtcttgaagtggatcagcttaccagactgactgattttatcagaaaagaacttgatgtataaagcaggaggaaatgcacatgaaggtactggtaacagcaacgaattattctaagtattgtcagccaggtaaaaagttactggaagaggctggctgtgagattattgaaaatccgcatggaagaccatatacgtttgaggagcttaaggaaattgtaggagatattgacggcgtagtcgttggagttgatacatggaatgaagaggtattccgtcttgcaccgaaattaaaagttctggcaagatttggcgtaggcgtggataatatagatctgaaagcggcagaaaaaagagaaattgttgtctgcaacagtccgggaatcaattcatcggcagttgcggagcaggctgcagcattgatcctttcttcaatgagacagattccgcagatgaacaatgcagtgagagatggaaaatggcctcgcccgatgtttcatgaacttaagagccgtacaattggatttctgggatttggagcaattgcaagaaatcttgcagaacgtcttgcaggatttcatccggaaatgatcgcatatgataagtatccgaatcaggagatggcagataagcttggagtaaagttggtttcacaggaggaagttctgaaaaaggcagatattatttcgattcaccttccggcaacggacgagacaaaacatctgatcaaccaggaaactcttaataagatgaaagatggtgtttatgtagtaaatacagcaagaggcagtatcgtttctgaaaaagatatggcagaagcgttaagaacaggaaaagtagctggatttgcatcggatgtatttgaaacggaaccgatcgatctttctggttcgctgtttggctttgaaaactatattgcaacccctcatgtttcagcagagacatatgaaaactgtgagacgacttctgtggtgacagcgaaagcaatcctagcagtttttgatggaaaagaaccagagcataaacttgtatgatcgtacaaaataaaggcagaggatgacctgtttaccgggaaaatctattgatgaaaaaatttattgatgctatactattactattaacagtaacgctatatttgttatattgttatataggttttgaccagctaaatggtaaaataaaatctatgaggaggggtaatggctgacaataatgaaattaaagtaaagagtcttcagaaggctttggaaattctgaatctttttactgtgaaacctgttttgggagtgacggaagtcagtgagtactttggatggtataagagtacggtacataatattctgtgtacccttaaatctatggagtatctggaacaggatgaagaaacaggaaagtatcggttagggattcaggttttcaatctgagtaaagctctgggagataattattctattactaaaattgccggaccttacatgcaggagttatcaaatattaccagagaaagagtttatctggcggttccatatcgagaggaagtattgtatttggatgcaatgtatccagcagaatctgttgagctgatgcgttcgatccttggagagagggctcagatgtattgcactggtatcggtaaagcgatgctggcgaatatgaatgatcgttcaattgacgaatacctgactgtacatgaactgaaagcatttacagagaacagcattacagataaagacgtgttcagacaggaacttatgcgtactcgtcagagaggatatgcgattgatgatatggagcatgaatttgggataaaatgtgttgcaatgccgatatttgaccgtaacagaaatctgtatgcggcaatcagtatcagcgggcttgcaagtcattttacagaagagaaaatgtctgaatgggcgattcttctgaaaaaatatgttaccaaaattgagagcagattataaaaagaaataaaaaactgtcattgcatatgcagtggcagtttttgcgtgaggtaagagcaggacaggagaaaataaagacaagaaaaaagacagtcactgacggttgtgactgtctttttaattataagcttataattaaaaatgtatatttcctgaattagccaatgctgttgacagctttagacagacgggaaatttttcttgcacagttatttttgtgataaacacctttagatgttgctttgctgattgtagagatagcctctgtaagagcagcctgtgcagcagctttatcgtttttctgaactgcagtttctacttttttgatggaagttttaacagcagaacggatagatttgtttctagcagctttagttctgtttactaaaattcttttctttgcagatttgatgttagccaattggtacacctccatttcagatttataataatgtgtcgttgttacagaaacagacacgggcgcttctgtaaacatgcttatatatgatagtatatttatttttacttgtcaatagtaaaatgcggaaatgttaaaaaaatataaacataatattactgtgagaaaaatcttccatacataatataggcttaaaacagagacattaatgataaagtgaaatattgtagacagataagaaacaaaattttacagatgataatcggatatcaataattcagatgatcaggaggaagagagatggcagtcagcaaaagaatcagaacagaccttgcactggaaacaacagaacgttttaaagaagaaaacacagagattcgtggtgtagagattcaggaggactatgatgaagaaaaggatgtacgaacgactgtcgtcaggatcgtgacagaaaacggtgcaaaggcgatgggaagaccgcagggaacttacattacaatagaagctccggatctgtctgtaccggatgaagattatcatcgtgagatatcagaggagatttccaaacatctgaaacaactcattgatctgaaaaaggaaaaatccattcttgtggtggggctcggaaatgcaggaatcactgctgatgcactgggaccgcatgtggtagaaaatttaaggatgacccgtcatatcataagggaatacggccttcgaggaattgatcatgaaaaaatgcaccgtgtcagtggaattgtgccgggagtgatggcacagaccggtatggaaactgcagagatcatacagggagtggttgcggaaacgaaaccggatgtagtagttgcaattgatgcacttgcggccagaagtgtccgcagactgaatcgaacgatccagattacagatacaggaattcatcctgggtcaggcgtgggaaatcacagaaatggactaacggaggacaatctgcaggtaaaggtgattggaatcggtgttccgacggttgtggatgcggcaacgatcgttcatgattcgatggcacatcttctggatgcactggaagaagcggagcagaaagaatttttggaagaaatgattgctccgaatctctacagcatgtttgtgacaccaaaggatgtggatgagacggtaaaatacctgagctttacaatatctgaaggattgaatacagcgttcggtgaggcatgactttcatgaataaaaattcgctaactgatttatgcagaacaaatgactggtagaatgatgcaaagtcataattgaggttggtttgtcataggatactttgaaaggagtggttctgtggcgagattccggaaaacactgtatctgattgtggaaggctgtgtgcttgtgacgctatccgtgacagcgggcgttcttgtgctgcacgaaaatgtatttcgccagcttccattgtactgttttctggaagagaaggcacaggagcgttcagttggacaggaccgtgagacttatgaaaagctgatggagagcaatgcacgttatcttggcaggatggtcgtagatgagaataaagaagtcggaagccaagaaaatgataaagagattgtggacaagcagacaaagagagagaacgaacagaacttaaaagctgagagacaggaagagaatgtgataactccaactgagaaaacagaggttacagtgactccgataactcaaaatacagaagagcagaaagtaaaaaatgcagataaacagacagagccagaagaaaatttaaccgaagaatctaccggggaagaggaagttactacggcagccgcccaggtgcagccgatgccggaaattgaccttgcaccggaaagactggcagattacgattatctgatgaatcatttttttattcttgatcctaatacagaaaccagtgcgcaacagttgaatgcggctgctcttcttggggaggatctgacgctccgtaaggaaaaagcggagccacagattttgatctatcatagtcattcgcaggagacttttgcagattccagagaaggaaagacagaagatacgatcgtgggggtgggggattatctggctcagcttctgacagaaaattatggctatcaggttatgcatgtaacggaatcatttgatctggctggaggggaacttgaccggagtaaagcatatgactatgcaagagcgtggctggaacctgttctggaagagaatccatctatacagattctgatagacctgcaccgggatggcgtaccggaagatcgccatctggtcaccgaaattaacggaaaaccgacagcgcagatcatgttttataatggcttgagtcatacaataaacagcggtgatctttcataccttccaaatccgtacatacaggataatctggcattttctttccagcttgagtatcaggcggctctgtactatcctgaattgtaccgtggcatttatctggcaggattacgttataatctgcatctgcgtccacgagccctgcttttggaggcaggggctcagacaaatactgtccaggaggtaaaaaatgcaatggatccttttgcggatatcctgaaccgggtgctgcagggggaaaattaaaaaaataacgcttgcaattcagaacaaacgttcgtataataagaacacagatcagtaatacagacgtgaacagcgtcataacggtgtgtcagcagaaatatccctttacaagaactggactaaaggtaaaaagctatgctataatgcctcgtagtatgattttctatactttatatataaggaatagttttttggaaaataaagagaagtacataaggaggaatttcgcagaatgatagaccagagcaaaattcgtaatttctgcattattgcacatatagaccatggcaagtccactttggctgaccgtattattgagaagacgggtacactgacagaacgtgagatgcagtctcaggtgctggataatatggagcttgagagagagagaggtatcacgatcaagtctcaggctgtacgaatcgtttataaggctaatgatggagaagaatatatttttaacctgatcgatacaccagggcatgtcgattttaactatgaggtttccagaagtcttgctgcctgtgatggggcaattttggtcgtagatgcagcacagggtatcgaggcacagacgctggcgaatgtttatctggcattggatcatgacctggatgtgcttccggtcattaacaagatcgatctcccaagtgcagatccggagcgcgttgtcaacgagattgaggatgtgatcggacttgaggcacatgatgcaccgagaatttctgccaagacaggattgaatgttgaagaggttctggagcagatcgttacgaagatcccggcaccgcagggagacgtaaatgcaccgctgaaggcattgatctttgactctgtttatgatgcttataaaggcgtcattgttttttgtcgtgttatggacggccgcgttaagaaaggtactcagatccgtatgatggcaacaggatttacgactgaagttgtggaagtaggatattttggagccggacagtttattccgtgtgatgagctgacagccggtatggttggatatattaccgcaagtattaagaatcttggggataccagagttggtgacacagttaccgataatgaaagaccatgtgcagaagcacttccgggttacaagaaagtacagccaatggtttactgtggactgtatccggctgatggtgccagatatggtgatcttcgagatgctcttgagaaactgcagctgaacgatgcttctctgttctttgaaccggagacatctattgcacttggctttggtttccgttgtggattcctcggacttctgcatttggaaatcatccaggaacgcctggaaagagaatacaatcttgatctggtaacgacagcaccaggtgttgtttacaaagtatataagacgaatggagaagtgatcgaactgacaaatccatccaatctcccggatccatctgagattgaatatatggaagagccaatggtaaatgctgagattatggtaacgactgaatttatcggtgcaatcatggatctctgccaggaacgccgtggtcagtataacggaatggaatacatggaggaaaccagagcacttctgaaatataaacttccactgaatgagatcatttacgatttctttgatgcattgaaatcccgttccagaggatatgcatctctggattatgagctctgcggttatgaacgcagtgaactggttaaacttgatatccttgttaataaggaagaagttgatgcactttctttcatcgtacatgcagatactgcttatgagcgtggacgtaagatgtgtgagaagctgaaagaagaaattccgagacagctctttgaaatcccgatccaggctgcaatcggaagcaagatcattgcccgtgagactgtccgcgctatgcgaaaggatgttcttgccaaatgctatggtggtgatatttcccgaaagaagaaacttcttgagaaacagaaggaaggtaagaaacgtatgcgccaggtcggaaacgtagagattccacagaaggcatttatgagtgtactgaaactggacgataaataattgacgggagagaccgtgaatatggaatgcatattgttgtgaacggcggacttacagaagggaggcagggccatgaaaaaaggaactgcaaaagctatgagatatattgttgcggggagtgcattgacactctgtgtgattatgacgggatgtggctgcgggcagaaaaagacagatcctgcttcggaacaggtactgaagatcagtatcacaccggaaccatcaccaacactggcaccggatacggtagatgcggcagcagttacttcgaatggagatatcagtatggtgaatctgtatctggcagaaaatccatcagcggtgacaaacagtacagatacgggtgcgggtgatgcgaatactacagatgcttcgaatatgcagagccaggatcaggatcagtcggaagatacatcgggttcttctgatgagggtggagacagtgaagaataagaatcgtatcccattggaattgtatattcatataccgttctgtatgcagaaatgtcagtactgcgatttcctctccggtccatcggatcaggagacaagagacagatacatagaagctttgcttgctgagattcaggcagtgcagggtgttgaagcgtatgagatcgtttctgtttttatcggaggagggactccttccgtactgaaagcagaagcgattgcttctattatggagacaattcaaaagaaattctgtttctcgccggatgcggaaataacaatagaatcaaatcccggcacagttgatcttgcgaagctcaaagcttaccgaaaagcaggaatcaaccgtctgagtctgggactgcagtccacggattcgaaagaattgaggatgcttggaagaattcatacatatgaagaattttttcggagttatcagtgggcaagagaagcaggatttcaaaatattaatatagatctgatgtttgcaatccccggacagactggagaggcatggcgtgcgcaccttcggcaggtggcggagctgaatccggaacatatttctgcctatagtctgatcatcgaggagggaactccgtttgcggagtgtgaactggaccttccggatgaagatacggagtatcagatgtatgaggacactgcggggattcttgcagagtatggatatcaacaatacgaaatatccaattatgcaaaagacggatatgcatgtcggcataatatcggttactggaaacgtacagaatatcttggcctggggctgggagcatcttctctttatggggaaaaccgtttttccaatacgagagatatgcaggaatatctgggattttccggaaacacagaacgaattcgtaaagatgttctgaaactttcacttaaagaccagatagaagaatttatgtatctggggcttcgaatgacggaagggatttcagagatcgattttgaacagaatttcggacagaagcttgagaatatttatggttctgtcctgcaaaaatataaagagaccggatttctggagaagactggtacgaactggagatttacaagaaaaggaattcatgtgagcaatcatatcctggcagagcttctgttggatgaagaataagtgcgaacatgcagcggataagaggagaaaagatgtctgaacgaacaactggaaaaaagtttattaagattcgaggagcaaatgtcaacaatctcaagaatctgagtgtggatattccgagagatgaatttgtggttctgacgggagtcagcggatcaggaaagtcttctctggcatttgatacgatctatgcagaggggcagagacgttatatggaatctctgtcatcttatgcaaggcagtttctgggtcagatggagaaaccggatgtagagtcgatcgaaggactgccaccggcaatttccatcgatcagaaatctaccaaccgcaatccgcgttcaacggttggaacagttacagaaatttatgactatttccgacttctttatgcacgtattggtattccgcattgtccgaagtgcggaaaggaaatcaaaaagcagacagtcgatcagatggttgatcatattatggcacttcctgagagaacaaagctgcagcttctggcaccggtagttcgtggtcgaaagggaacacatgcaaagcttctggatcaggcgaaacgcagcggttatgtacgtgtacagattgatggaaatctgtatgagctgtctgaagaaattaaactggataaaaacatcaaacataatatagaaattatcgtagaccgtctggtagtaaaaccgggaatcgagaaacgattgtctgattccattgagacagttctgaatctttcggatgggttgctcatggtagatacgatggatggtactgtgaagacattcagtcagagctttgcctgcccggattgtcagattagtattgatgagatcgagccgagaagcttttcgtttaataatccgtttggagcctgcccggattgttttggtctgggatataagatggaatttgatattgatctgatgattccggataaatctctgagtatttcccagggagctattgtggtcatgggctggcagtcctgtacagataagggcagttttacaagagcaatccttgatgcactggcgaaagaataccatttcagcctggatactccgttccaggattatccggatgatgttaagaatgttctgatccatggtacaaatggacatgctgtcaaagtatattataaaggtcagcgtggagaaggcgtttatgacgttgttttcccgggcctgatcaaaaatgtggaacagcgataccgcgaaacaggatccgatgcgatgaaacaggagtatgagtcgtttatgcagatcacaccgtgtaagacctgcaaaggccagcgattaaaaaaagaatctctggcggtgacggtaggagatcgcaatatttatgaagtgacttctctttctatagaaaatctgaagaaatttatgagtgagctgaaacttactgaacagcaggaactgatcggtaagcagattctgaaagaaatccgtgcaagagttggttttctgtctgaggtaggtttggattatctgtctctgagccgtgcaacagcgacgctgtccggtggggaagcacagagaatccgtttggcaacacagattggttccggactggtgggggtcgcttatattctggatgaaccgagtatcggacttcatcagagagataatgataagcttcttcgtgcactgatgcgtcttcgtgatctgggtaacagtctgattgtggttgaacatgatgaagataccatgcgcgcagcggactgtgttgtggatatcggtccgggagccggagaacatggtggagaactggtggaaattggtacggcagagacgctgatgaagaatgaacgttcaattacaggtgcttacctgagcggacgttgcaaaattccggtaccgacagaacgtaaacaaccgaccggctggctgaaaatccgtggagcagcagaaaacaatctgaaacaggtaaatgtagatgtgccgcttggcattatgactgcggtgacgggagtcagcggctctggcaaaagttccctgatcaatgaagttctgtataagacgcttgcgcgagacctcaacagagctagagtgattccggggaaacataaagaaattcagggactggatcagctggataaggtaatcagtatcgatcagtcaccgatcggacgtacaccgcgttccaatcctgcaacctatacaggtgtgtttgatcagatccgtgatctgtttgcatctacagctgatgccaaagcacgtggctataagaaaggacgtttcagttttaatgtcaaaggcggacgctgcgaagcctgcagtggtgatggtatcatcaagattgagatgcatttccttgcagatgtttatgtaccatgtgaagtctgcaaaggcaaacgatataaccgtgagacactggaagtaaaatacaaagacaagagtatttacgatgttttgaatatgacggtggaagaggctcttgctttcttcgagaacattccttccattaagagaaagattcagacactctatgatgtaggactttcttatatccgtcttggacagccatctaccgaactttcgggtggagaagcgcagagaatcaagcttgcgactgaactcagcaaacgcagtaccggtcgtaccatttatattctggatgagccgacgacaggacttcactttgcggatgttcataagcttgttgagatcctgcagcgcctgacagagggcggcaatacagttgtagtcatcgagcataatctggacgtgatcaaaacagcagattatatcatagatatgggaccggaaggcggtgaacgtggaggtactgttattgcaacaggtacaccggaagaaattgctgtctgcccggattcctatacaggccagtatgtggcaaaatatttaaagtaaacggccggttattgtgcgtgttaatatccgcaggtgttttgttatgaataagggacttttcaattgctgaaaagttgtttataataagcgtgattatatgtataacgaaagaatatcagatttttacaggaagcatatggaagggagatcttatgcctgcaaatgatataggaatagatctgggaacgacaaacagtctggtatattctacgggcagaggccttgttttgagcgaaccatctgtagtagtatatgataaagatacagagaagatcaaagcaattggtgaagaagcccggcagatggctgggcatgttacttccaatatggaagtaatctgtccgattcatcagggaatgatcatagattttgtcgttatggaaaaaatgttgaaatattttatcgccaaggcaatggggcggcgggcgttccgcaaaccacggatcagcgtgtgtgtgccgagtggtatcacggagatcgaacgtaaggcagtggaagaagcaacttatcaggcaggagcgagagaagtgtttctggttgaagaaccaatcgctgctgcaatcggtgccggtgtggatattaccaagccttttggcaatctgatcgtggatattggtggcggcacaacggatattgctgttatttcgattggcggtgttgttgtgtcatcaacgatcaaggttgcgggagatgcgtttgaccaggcaatcatgagttatatacgaaagacgcacagcttgtttatcggatcggatactgcagaagcaatcaaaataaaaatcggcacagctatcgaagaggcgaatccacaggtgatggaagtaaaaggacgaaatgtacttacaggacttccgaaaaaagtaaaactgacttccgaagaaatccgtgtggcactgaaagatgcgacaggacagatcgtagaagcagtccatggagtgctggaaaagacaccgccggaactggccgctgatattgtggacagaggaattgtcctggcgggcggaggagcactgcttcggggaatggatgcactgatcgagcagaggacaggggtaaatactctgactgttcagaatgcgatgcatgtggtagctgttggaaccggcaaatatgcagagataatgagccgtatggaatcttaataactgcagacaggagccaggaatatttatgatagatcatagatatcctggttttgctgttataaggctgaaaaacagtagcaattttggggtcggaagaaagaggaagaaatgagcgagagcattacaggatatattgatcatattatttttcgaaatgaagataatggatatacggttatggtattaaaagggggcagcgaggaagatgagctgacctgcgttggaagttttccggtggtcacacagggagcatctgtagaactggaggggaattttacacagcatccggtttatggaaagcagtttcaggcagtgcggctgactgaaaaaatgccggaagatgcactggctatggaaagatacctcggttcgggtgcgattaaaggaattggcgcggcactggcgggaaggatcgtacgtcattttggagatgatacgtttcagatagtagaaaatgagcctgaaagactgtctgaagttaagggaatcagtgaaaaaaaggcaagagagattgccatgcagatcgcggaaaagtccgatatgcggaaggcaatgatgtttttgcagaaatatgggatttcactgaaccttggtgccaaaatctaccagaagtatggagactctgtttacagtgttttgcaggaaaacccgtatagacttgcagatgatatcagtggtgtgggattcaaaattgcagatgagattgcctatcgcattggaattcatacagattcagattacagaataaaaagtggaatggtatatactcttctgcaggcaaccggggagggacatgtatatcttccgaaagacgagctctttcagcgtgcagcagaactgctcggtgtagattcttcttatatggagaagcatctggtcgatctggcgatggaccgtaagatcgttcagaaggaacaaggagatcagatactgatctatccggctcaatattattatctggagttaaatacggcaagaatgcttcgggaacttgatattttctgcccggaagatgagaaaatagtggaacgaagaattgtccagatagagaaagaaacgggaacggttttggatgaaatgcagaaaaaagcagtgcaggaagctgccgggcatggcctgcttattctcaccggcggtcccggtaccggaaaaacaacgacaatcaatgcgatcatccgatattttgagggcgaaggtgcagagatcaggctggcggctccaaccggaagggcagcgaaacgtatgacagaggctaccggctatgaggcacagacgatccatcgccttctcgaactttcgggaatgccagaagatgacagagaaggccaacccattcattttgaacgaaatgcagaaaatcctctggaaacggatgtcattatcattgatgagatgtcgatggtggatatacatctcatccattctcttcttatggcagttacggcaggaacgagactgatcctggtaggagatgaaaatcagcttccaagtgtgggaccgggaaatgtgcttcgcgatattatccgaagtggacagtttccggtagttgaactgaagaaaatcttccgacaggcatcagagagtgacattgttgtgaatgcacataagatcaataaaggtgagcaggtggaaatcaataacaagagccgggatttcttttttctcaaaagatacgatgcggatatcatcattcgcgtagtgattgcactgattcaggaaaaacttcccaaatatgtggaagcaaaaccgtttgaaatccaggttctgacaccaatgcgaaaaggacttctcggtgtggaacgtctgaatcagatcctgcagagatacctgaatccgccggacgcttccaagaaagagaaagaaataggacagggacttttccgtgagggtgataaggtcatgcaggttcgcaataattatcagctggaatgggaaatccgcggaagatatggaataccgatcgaaaaaggtgttggagtttttaatggggacaccggcatcatcaaaacaatcaatgaatttgcagaaacagcagaagttgagtttgaagatggccgatgggcggaatattcatttaaacagctggatgaactggaacttgcttatgcagtaaccatacataaatcacagggatcagaatatccggcagtgatcattccactgctttccggtccgagaatgctgatgaacagaaatcttctttatacagcagtaacacgtgcgagaaaatgcgttactgttgtgggaagtgaggagactttccgtgatatgatccgaaatgagaagcagcagagaagatacagctcgctggatcagcgcattcaggaaaccgaataaatctctgcaaaagaactcgataacaggaaaagagagcatatcatcggggagaaaggctttctttgaaaaaaataaaagaaaaatgtctggatgtactgtaccctcccagatgtcctgcatgcggcggtattctggaggataaacaaagaagtatctgtccgcagtgcgaatcgatttttcaccctgtttcagaatattattgcatgaaatgtggaaaaccggtaaatgagacggaagaatattgtagtgaatgtcggcacagagaacggaaatttattcgtggaagaagtgtgtttctgtataatgcgcagatgaagaattctcttcttcggtataaatattacgggagtcgtgaatatgggaaatattatgcggaatcgatgtgcagatatgtgggaagagatataaaaagctggagaccggacgtaatcattccggtgccgcttcacaggcgcaaaaagagaatgagagggtttaaccaggcggccgatttggcagagcgcattgggaaaatccttggaattccggttgcggaagatgttatttataagtccagggaaacacggtcacagaaaaaactggacgctgaagagcgaaagaaaaatctcagaaatgcgtttcaggcagcagggccggtaacaggcctgagaattcttgtggtcgatgatgtgtatacgacagggagtacagtggaagccatggcagaatgtctgctggaaaatggagcgaaagccgtattttttgtaactttgtgtacgggaaacatctgaatgggtacatctttgaacgaaggttggacggaagcggaaaaaatacttttcatgattcgggatatatgatacaatcaatctatgtatgattatttctggtattttcaggaaatatggtttgaacaagttactgtgtacagtaacaatgattgtgaggagcaggatatgatcaacgaagagaaggttaagattatgacaaaacttgccatgtatgagcagggcaagggcagaaaatatctgccggtcagcaagtattaccgaagcgattatatagggctggcactgatcaagaatttttttctggtcacaattggatattgtctgagcgttgcagctgtagcggtttattttggagaatatcttctggagaatatacacaaaatgaatctgataatgctcggtgtatatattgtgatcggctatctgatcgtacttgtggcatattcagtcctgacgtatatacagtactcggttcagtattatcgggcaaaaaagagtgtcagagaatactacagtcagcttactgaactgaataagatttatgccagagaagaaaaaaaatcttccggcagaggaaacgcaggagggtatcgtaaatgacagcattactggaattcaaacagaaaataaaaggaatttatgcacagtacgaaatgtacctgcttcctttattgaaatttgtccttgcactggtttatttcatctggatcaataccaacatgggatatatgactgcactggataatatttttgttgtattgatcttatcgctgatctgctgtattcttccatccggaatgatgatcttcgcaggatttgcactgatggtgggacattgttatgcacttggaatcgaagtggcagcttttcttctggtactgattctgttcatgatgatccttttcctgcgtttcagcagcggtaaaaatatcgtgcttgtgtttacaccactcgcatttgcatttgatattccggtgctgcttccaatcggatgcggacttctcagcagtgcggtatcagcacttccggcagctggcggcgtgatcatctattattttgtccgtacagtacgtatacagtcgcaggctcttcttggcatggactcagacattgtcggtaaactgacacttctgtcagacagccttatgaagaatggtgaaatgtggcttacactgattgcttttattgtagtggttcttgctgtgaatctgattcgtacccgcatgtttgattatgcatggagaattgcaattgttgccggtggagtgatctatattgtgatcatgctggcaggaagtatgagtcttggaatttcaatttccgtattttcactgatcatttatactgtggttgcggtactggttggaatcatactggagttctttgtgtttggtggagactatacaagaacggaacgtctggaatatgaagatgacgattactattattatgtgaaggctgttccgaaggcactggttgctacttctgaaagaagtatcaaaaagatcaacggagaatctgcaagagaagaacgaaaatcggcagagcgcgtggtaaattattccacccctctttttcagggggaagagccaccgaaaaagaaaaaaagagttcaggaaacagaagcggcgtctgtagtacagaaggctgatatagatgatattgattttgagaaaaagctggaggaatccctgaaggatctgtgatccggcaaaagtaacctgacaacagcaacagaaggagaggagagtttatgcggaatattacagacatactggcaagatatttatcagatatcaatctgccgtctgtcagtattatcgatatcattgaaataatcctgattacattttttgtatatcagttcatggtgtggatcaaatttacacgcgcatatactctgcttaagggacttctggtcattggcgcatttcttattattgcttatatatttaagatgaatacgatcctgtggatcgtatcaaaactggccagtgcactgatcacggcgatcgttgtaatatttcaacctgaattgcgaaaggtcgtggaacagctgggacagaaaaaaatcatggcatccatttttccttttgattccggcaaagaagtaaaagaaagatttacagataagacggtcaatgaactgatcaaagcatgttttgatatggctgaggttaagacaggcgcactgatcgtgatcgaacaggagatcagacttgatgaatatgtcagaacgggaatcaatgtggatgctcttttgaccagtcagctgctgatcaatatttttgaacacaatacaccactccatgacggtgcagtgatcgtaagaggaaatcgtattgttgctgcaacctgttatcttccactgtctgacaatatggaactgagtaaacagcttggaaccagacatcgtgcaggtgttggaatcagtgaagtgacagattctgttacgatcattgtttcagaggaaacaggacaggtttctgtggcacagaacggtcggctgttgagaaatatcagcagcagtcagcttcgtgaagtactggaaaaagcacagaataagaaaattgtggataacaacaaactgagacagttgttgaagggaagagtgaaacatgaagaaaaaaataggaaataatctttctttgaaaattctgtctcttgcaattgctattctggtatggcttctggttgtcaatataaacaatccgatcagtacaaagtcattcattgtgtcagatgtggaattgctgaatgaggcatatatcgatgcagacggaaaaatgtgtatgcaggatgaagaacaggttcccatccgtgtgacgatcaaagctcagagaaagatcctggacaggatctcactcaatgatattcgtgcggttgcggatcttcagcaggcggtgagcctgaaaacagatccggtcatggttccgatcactgtatcctgtgggcggatttcagcagacaatattgaagtgagtccgcagaatatgagccttcatctggaggataaagatacacaggagtttgtagtaaatgtgaatacaaacaacacaaaacctgacaggggctatgaaattggagcgctgacttccaatccggagaaaatcaaaattacaggtccggtgtctctgatcaataaaatagataaggtaaatgcttccatcgatgtagatggagcaatggaagatgtgactcaggagaccgatgtcaagatcattgataagaacggtgaggaatttaccgatacagacatgggttatctgaatgtttcgaaagtatatgtaactgcaaaattatggaaagttcagtcgaatgtcagaatcagtgcagagtattccggtactccggcagcaggatatcaggtggagagtattatgacaacaccgaatgtgatcagtattgccggaagtgaagatgcactggcatcactgaaagagcagaataatacgatctggctgccgggttctgtggcagatatttcggatcgaaacagtgattttgaagagaaaatcaatatttcagattatcttccggatggcctgaagcttaccagcgattccagtgaagatgtatttgtcagagtaaatattcttccggagggaagcaatgtatgtgaggttccgacaaagaatataattgtgaatgattcacctgagggaatgcaggtttcatttgatactgcaaagatagaaattcgtgttaagaaaacttccgatgatcttgcagatctcacagaaggcgatattaaagcgtcaatagatcttaagggaatgagcgaaggaagttatgaagtgcctgtcagcatagaaataccgaagggatatgagctggtagacgaagtaacgacaggggtggagatttccaaaatttctacagcagatgaaagcaattaacaggagatttcagaatggtaagtcagaagataacagtcaataatccatcgggacttcatttgcgcccggctggtatattgtgtaatgaagctataaaatacagttccgcgatcacattcacttttgaaggcggtacagcaaacgcgaagagtgtattgagtgtactgggagcatgtgtaaaatgcggagatgaaattgaactggtctgcgaaggggcagacgaacaggaagcattgaaagctttgaccgatgcgatcagcagtggtcttggtgaatagaaacatatgtaaagaagtttaaggaggagtagtcgtgaaaaaacaagttgtggcagtaatgttgagccttgcaatgtgcgcatctaccggtgcagaagcaagtattgtcagtgcagccgaattttcttctgaggtgtcagcagcagaggaaacggaatctgatgaagcgtccgttgcggacgagaacgatggttctgcagtagtagatgattccgcagtagtagatgattctgcagtcgatatcgattcagatgcggcagcagatgatgcagatcaggcagaagatagcgttccggcagatacggaaaatcaggcagatgttgatttcagttccggtgaggaagaggttgtgactgaagaggcagaggatgaggctccggcagtgacagaagaaactgcagaagaagctggtaaagcaaatgaatcatctgatgctaatggtaaagtagcttcccttgagtatacaagatggaaatttgtaaatggcaaatggaaactggaaaagtactcaccttccagaatacaggaaactgcagcagctgtcggaacagaagaaactgcagaagcagcaggaactgatgagaatgcagctgttgatacagcagcagaaactacagaagctgtagcagatgaatcacaggcggctgttgatacaactgcagaaactacagaagctgtagtagatgaatcacaggcagctgttgagacagcagtagaaacacagcagacagatgagacacagccggctgcagatgaacagcaggcagaggaagcaggtgcaagtgcttattatacatcagcagatggcctggtaaagattacaacattgaatgttaataacagtgttctggcttcaggatattatgcatttgataaagatggatatcttctgacaggaagaaatgctgttggaaatgatttctattatttccgtacagaaggcgatgttcagattgtgaatgcactttctgcagataagaagacaccttataattctcagctcggtcaggcaatttccgatacatggatctgggatgcaggtcagggagcatttaactattatggtcatgataatggtaaacaggtaaatcttgaagcaaacaagatttacagtatcaatggagcttcttactatcttctgaatggtggtaagccatacgtaggagatcagaagatcagcggaggcatctgctatttccagcccgcagcatctgcaggagatattcctggtaagatggcagtcaacggatggtttggaaagagtaccaataagggtacacagtggcgttattttaatgcaaacggagattaccagaaaaaaggaatcggagcatacaagcttctgagtaacagcgacaatctttatctgctggatgcaaatggttacctgatcagaaacagaaaaccagtcaagggtgctgacagatattattatatggctgacggtaatggtgttgcatacagaaacaaactgatcaaatacggtaaatacagatactatttcaccggcaatggacgtcgcgctacctggaaaaatcgttgggtgaaactttccggagcaggaaaccgctattattatttcggaaaagtagcaggacgtgttcaggaacagaagggaatcaagaaagttactgtcaatggtaaatttgtcggatggttctatttctcttccaaaggtaactcttttataaactgctggaagagcggaagatattatctcgcagacggacgtatggcaagtggtgttaccaaaattaatggtaaatattacttcttccagagatccagttccaaatcatatagaggtaaagtatacaaaagcaaatgggttaagtataatggcagatactattatgcttccaaaagcggtgtacttgcagaaaatggctggaaacgtatcaagacagacggaagattctattacttctatttcaagaatctgacagctgtaacaaataaaaccggtgtagaacacaatggaacttacggaagcctggatggcagaggtcgtttcattgaggctggctgggttgttgtaaataacaacagaaactatgtacgttatatcgatccgaagactggtaaatatgtcaagaatacaaccagatggatcaatggtatgcagtacagatttaacagcagaggatacagagtcaacgacagaacaaatgagttcagacgcagcagctattatctgacctgtgatcgtgtgaacggagtgctgactgtttacacagacagcaccatgagaattccgatcaaaacaatccgcgtttctgttggtaaagccggtacagagacacctaccggtacatggacaatgcacagagcaggacgctggcaggaactgatgggaccatcctggggacagtatggaacacatgttgtgaatggtatttttgttcattccgtagcatgtggtcaggcaaacagttataatcttccggttggagaatacctgagacttggaaatccggcatctcacggatgcatccgtgcctgtgtagctgatgcaaaatgggtttgggacaactgcaatggttccaagatccatatctttgatggcacatatacatccaatgaagcactcaaaggacctctgggcagaaaagcactcacacctttaagaggcagcaagaactttgacccgacggacccggcttgtaagtaaataataaaatacagcgctctcccaaatggagggcgcttttcaggaggaaagtaaaataatgagaacataccttgtaactggtggtgcaggatttatcggatccaactatattcattatatgtttaaaaaatatgacaacgagatccgtattatcaatgtagataaactgacttatgcaggaaatcttgaaaatctgaaagatattgaagaccgtgaaaattacacatttgtgaaagctgatatttgtgacagcgaggcaatcatgaagatctttgatgaaaatgacattgatagagtcgttcattttgcagcagagagtcatgtagacagaagtatccgtaatccggaagtttttgttaagacaaacgtacttggaactctggttatgctgaatgcagcaaaatctgcatgggaacttccggacggaacattcaaaccggacaaaaaattcctgcatgtatcaacggatgaggtatatggatctctggaagagaacggcggatttttctatgagacaactccatatgatccgcacagtccgtattctgcaagtaaagcatcctctgatatgctggtaaaatcctacatggatacttacaaattcccggcaaatatcacaaactgcagtaataactatggtccataccagttcccggaaaaactgattccgctgatcatcaacaatgcacttcagggaaagaaacttccggtatacggagatggaaaaaatgttcgtgactggctttatgttatggatcatgcaaaaggaatcgatatggtacaggaaaagggaagacttttcgagacatataatatcggtggtcacaacgaaaaacagaacatccagatcatccatatcattctggatactctgcaggagatgctcccggaaggggatcctcgtaaagaacttgtcagtgagaacctgatcacatatgtagaagatcgtaagggacatgaccgtcgttatgcgatcgcaccggacaagatcaaagaggaagttggctggtatccggaaacctgtttcgaagatggtatccgtctgacaatccagtggttctttgagcatgaagactggatgaaaaatgttaccagtggtgactatcagaaatattacgaagcaatgtataaaacaaaataatatctcataaaagatgagatcagaaacgctgtatattttaggaattctcctgatctgtacagcgtttttttatgcacagagatatggaaaaagattttagcgaaaataggcattgaatttacagagcgattgtgagaaaataatatgagatatgtctagctttaaaaagcagaatctgacaggctgtataagatagcagcttataacaatggaggtaaatagatgaacaaaggaatataccggattgcggctggtgttggtgcggcagtgattctggtgtcttctgcgacagcacaggcagcaaccgtaactgcaaatggaactcctgcaccggtagcgagtgacagcattgcaggttggccggcagctcccgctgtcacgtcagaaacagcagttctgatcgatgcagatacgggagcggttttgtatgacaaaggaatggacgaatatcgttatcctgccagcacgacaaagctcatgacgctgttggttgcaatcgagaacagttccccaaaggatattgttacttttacagaaacaggaatcagggatgtcacctgggacagcagtaacatcaacgcacagcttggtgaaacgatgacgatgaaggactgctggatggctgcatatattaaatcagccaatgaagtctgtgcacagattgctgagacggtaggtgggacagaagcaaattttgttgaaatgatgaaccagaaggcaaaagaacttggatgtacacatacacattttgccaatgccagtgggctgccggatgaaaatcattattccagtgctcatgacctggcaaagatcatgcgtgcatgccttcgaaataaacgtttccgtcaggtgatgaaatgttcgaattataagatcccggcaacgaatttaagcgaagcaagggttatgcatacgcatatgccgcttatggcaaaagagtccaatctttattatgcagactgcataggcggtaagaccggattttcaacggatgcacagcatacacttgtgacagctgctgaacgaaacggacgtacgtatatagcggttaccatgcgtgcagcggatcttggaatcaactgtaccgacagcacatcattatttaattatgcatttgataattttgatacaattgatgtggacggaacagcaatgacagtgccaaaaggcgttacggtcaatgatctgacaaccgatacagcagaacgaaatggaaagatactgaccagatattactatagcgggcagtttgtaggctatgtggcagaagcacagccgacagaaactccggccgtggaagagacagctgaaacagtagcagaatcttcagaaacagaggcggctgaaactgtgacagattcgctggagacgacggaaaatgattctcaggcagaggttcagactggacagaaatccatgtccgagcagattcaggagattcgtaccgagggattatccggtatgatgaaagctcttttgatcgcaatgggagtcatggcagtgatcctgatcgcattattgatcgcactttatataaagaatggatgaaaataaataaagaacttgaaataaaggaggaaacataatgaaaggtattattttagcaggtggttcaggaaccagattatatccattaacaaaggcaatttccaaacagatcatgccggtttatgacaaaccgatgatctattatccattgtctacactgatgcttgccggaatccgtgaggttctgatcatttctacaccaagagatcttccggttttccgtgatcttctgggagatggaagccagcttggaatgagatttgaatatgcagtacaggaacagccgagaggactggcagatgcatttatcattggtgcagatttcattggcaatgatgcagttgccctggtacttggagataatattttctacggacagagcttttccagagtccttcagaatgcttacagacgcacagaagaagaaaaaggtgcgactattttcggttattatgtaagagatcctagagaatatggtgttgtagaatttgatgagaacggcaaagctctttctattgaagaaaaaccggaacatccgaagtcaaactatgcagtaccgggcctgtatttctatgataatgatgttgtagaaatcgccaaaaatgtaaaaccgtctgcccgtggtgagattgagatcaccagcatcaacaacgaatatctgagaagaggaactttgaaggtagagactctgggacgtggatttgcatggctggatacaggaaatcatgattctctgcttgatgcagcagattttgttgcagcattccagaaacgtcagggactgtacatttcctgcatcgaagagattgcatacaaacgtggatttattacaaaggagcagcttgttgaactggcacagcctcttcttaagactgcttatggaaaatatctgattgaaatagcggagggattataaaatgggaaaaattacagtagagacatgtcatattgaaggcctgaaagtgatcacaccggcagtattcggtgatgaacgcggatattttatggaaacatataactacaacgattacaaagcagccggaatcgatatggaattcgtacaggataaccagtccagttcccgtaaaggcgtacttcgtggacttcatttccagatcaactatccacaggataaacttgttcgtgtagtgagcggagaagtttttgatgttgcggtcgatctgcgagaaggttccccgacatatggacagtggtatggagtccttctttctgcagagaataagaaacagttctttattccgaagaattttgctcacggatttgttgttctttctgattctgcagaatttgcttataaatgtaccgatttttatcatccgaatgatgagggaggtcttgcatacaatgacccggatatcggagtagaatggccgattccggaaggtatggaactgatcctctctgacaaagaccagaaatggggaagttttaaggaatatactgccaacaggagtaaaaaggattgaaaaaagaaacatggctgcctggggaaatctacaaaaaccgcaaattagtgttttctctggcaaaaaatgatttcaaaacaaaatatgcgggttcctattttggaacagtctgggcatttgttcagccgatcgtaacgatctgtgtttactggtttgtattcggactggcgcttcgcaatggttcggataaaggtgttccatttgtactttggctgatcgcaggtcttgtcccctggttctttattcaggagggcctgaccggaggaacgaatgcacttctggaatataattatctggtaaaaaaagtagtatttaacattcggatccttccggtagtgaaagtattttcagcggtatttgtacattgtttttttgttgtgatcgtactggtgatctatacctgtatgggatatccgccgagtctgtatgcactgcaactggtatactacagcttctgcatttttatgctgatcctggcagtcacatatatgacaagtgcggcggttgtattcttcagagatctgagtcagatcatcaacattatgctccaggttggtgtatgggttaccccgatcatgtgggattttaatgatcttggtcttggaggacttctggcaaatatattgaaactgaatccggtattctatattgtgcagggatacagggattctctgatcaacaaagtagcaatctgggagcatccggtgctgacactttacttctggggatttaccctgatcgtatttgtgcttggaaccagactgtttaaaaaacttcaggtacattttgcagatgtactgtaagcggagagtagaatgagtgaatttgcaattcaggtaaaacatctggataagatgtataaattatataataagccgtctgaccggttgaaagaggctctgggaatgaaagttcctgtaagagagcattatgcactacgggatgtcagctttgatgtaaaaagaggagaaacagtgggaattatcgggacaaatggttccggtaaatccacgatcctcaagatcattaccggtgtattgaatcctactggcggagaagtcacagtagatgggagaatttccgctctgctggaactgggagccgggtttaatatggagtataccgggattgagaacgtatatctcaatggaactatgatgggtttttccaaagaggagattgatgccagactgcaggatattctggattttgcagacatcggcgattttgtacatcagccggtcaaagcatattccagtggtatgttcgttcgtctggcttttgccgttgcaatcaatatcgatcctgaaattctgatcgttgatgaggcactttctgtaggggatgtgttctttcaggcaaaatgttatcgtaaattcgaagaatttaagaaaatgggtcggacaatcctttttgtaagccacgatctgagcagtatttccagatactgtgacagagttatccttctgaataagggtgtgaagctggaagaaggttctccaaagcagatggtagatatgtacaagcagcttctggtaggccaggatccgaccaggaaagtggaaaaagaagtaaagaaaaaggaaaactggagtgaaaaattccaggtaaatccgaatatgctggaatatggcagcaaacttgctgagatcacagattttgttgtgatggatgaaaagggccgttataccaataccatcgacaagggaacaacctttacgatcaagatgagggttgcatttcatgagaatattcaggaaccgatcatggcatatacatttaaggatattcgtggaacagaaattacaggaaccaacacgatgtttgaaaaaatgcatattgagcattctgaagccggagatgtatgtaccgtaacctttacacaggatatgttcctgcagggtggggagtatctgctttcctttggatgtaccggctataaggatggtgactttacggtattccacagattatatgatgcatgtaatattacggtgatctcaacgcagaataccgtaggattttatgatatgaattcaaaagtagaaattcagtacggagaggaataatggaaaaaatcggacaggtaattctggatgatacactatatccgggcaaagatttgtatacagatggtgcaattgaggatgagatgctggaaatagcacgcaattaccgggaaaaacaatggaacggagttattgcagagcgggcgagctggccgattctctatcatttttctcatatcagggaaaatatactgagctggattccgtttacaggtgaagagaatgttcttgaaatcggttccggatgtggtgctgtgaccggcgctctctgcaaaaaagccaaaaaggttacctgtattgaactttcaagaaagcgaagccagatcaatgcatggagacacagagactgtgacaatctgaagatccttatggggaattttcaggaagtcgagaagacgcttaccgaaaaatatgattatattacattaatcggtgtgtttgaatatggagaagcctatatacagagtgagactccttatgtggatttccttaagatcatatccagacatctaaaaccggatggtaagatcgttcttgcaatcgaaaatcgtctggggctgaagtactgggcaggatgtacggaagatcattttggaactctctttgaaggtctggaaggttatccgacaacgagtggcgttaagacattttccagaaaagaaatgtcagcaatcctgaaagaggcaggaaatcttaaagcatcctggtattatccatttccggattacaaattaccaatgacgatctattcagaccgtcgccttcctttgaagggagaactgaatcgtctggaaacaaattatgacagactgcgtttgcagcttttccaggaatctgcggtatatgattcacttcttgcgaatgatatgtatccggattttgccaattcttttcttcttctgatcggaaaagaaaagaaagaagcagaaaccatttatgtaaagttttccaatgaaagagatccggcattttctgtgcgtacggaaatctgtgaaaactcttcagggagaagatatgtccgtaagttaccgacagaaaaaacttctgaagaacatgtgaagaatctggaaaaaatctccagggaactgggaaccttttacggaagagaaggtctggaactgaatacctgtacagttgagaatgatggagtacgtctggaatatctgcagggagagacactggaaggaagactggacgaacttctggaggcaggaaagacagaagagcttgagaagctgtttttcagctatatcaaaaagatccgtcgtatccatgaaggagagatgttctttaaaacaccggaattcgtgcaggtctttggtgatgcagaaatcagtgaaagctgtcgttgcagcggcatgtccaatatcgatcttgtgccagctaatattctgcttcaggattccggagtgtccgtaatcgattatgaatggaccttccgctttccgattccgtgcaatttcatcctttacagaatgatccattactatctggaaagtgatggcaagcgtgctgtactgcgtgatcttgatttctataaaaaggcaggaatcagtgagaaagaactggaaatttatgcagagatggagcgtaatttccagaaatatatggaaggcggtcatgtgcctcttcgggaaatgtatgatgaggtttcacctggcaaggtagatatcatggcatattatgaccggatccgtgccgcatgtgcaacgagaagactgcaggtattttatgaccgaggaaatgacttttcggaagcggattcagatatctatccaatgacaaaacatggaattgatttcggaatcactgttccgcagaatgtgcgccgactgcgtctggatcccggggaagctgccgggggactggtccttaaaaaacttgtatttgaaaacggaaaagaggcggatttttcttctaatggttttccgataggaaacggaagatactattttggaggcggagatccgcagtttgtaatagagagtctgccaaagaatacaggcaaactttatatagagattgaagtgatgaaggaatctgaagcacaggaggcgttctggatgagtttttcacggatctcagcagaaaaagacaaagagattcagaaactaaaacatcagatttctgaaatgaaaaatacaaaggcatggaagctgtaccggagtattaaaaagaaataggggaatatttatggacaaactttgtttcagcattgatgaagagagatacgatgacagacatggacatgtgctgagccttgtaggttggtatatgcatcctgaaaaaaagaaatgcatctttcagttgcttggggatggttatgaagtaatcgatataccggaaatcgagagatatgaacgcccggatgtggcgcagtctctggatgtggagacagaaggatttcttccgggttttactgtgacgattccagaggtactggaacttcgcagaaaatacgatctgttagaacttcttttgctggacggagaagaaaaaacactgctttgggagtgtgcgggtgatgacctggatgaactggtcaaggataaactggtagaatttcatattgaccgtgtagaggtactttatggactgatgctggaaatccagggatggacaacggaccagagaggaaatgtggaagtgacggttcacaaagaaaacacggaacttctggactgcaagatcacaagaggacgcagaccggatgttgtggaacgtcgtcatctcgatgatgattacaaaaatcaggagatcggattcagtatttcagcagcttttctggaaattccggggaatcgtatcgtacttcatttttgtggagattccacaacaaagacttatgaaatcgatattaaagcacttcgtaaagagcagaaatccaaaggattctggggacgcctttttcataaagacaaagatggagaacacaaggaagactatgaagagtggttcaaacgccataaagctgaccggcgtacactcagaaaacagagacatacacattttgagcagaatccgctgatcagtattgtgattccgctgtactgtactccaaccccatatctaaaggaattgatcgattctgttcgggcacagagttacacaaactggcagctttgtctggcagatggaagtccggatcagaaagtagaagaatatattcagaagcgttatggaaaagacagccgtatcctgtacaaacatctggaggaaaatggcggtatttccattaatacaaataaagcgattgagatggcgacgggggaatatctgatgctcagtgatcacgacgatacgctggaaccggatgcgttatatgaaatcgtcaaagccatcaatgaccatcaggggccggagattgtttatacagatgaagacaagctgagtatggatggggaattttattttgaaccccattttaaatcagattataacctgtttcgtttaagagataataattatatctgccacatttttgcagtcaaaaaagccctggtagatcaggtaggcggtctgagacaggagtatgacggttctcaggattatgattttatcctgcgttgctgcgaacaggcaaaacaggtaatccatattccgagagtactgtatcactggagatgtcatatgaattccgttgcggcaaatccagagagtaagacgtatgcgtatgaagccggatgccgtgcaattcaggaacattacagaagagttggtattgaggctgaagtggagatgacgaaacatccgggctggtatcgcagtcatgtgaagattcagggtgagccgcttgtttccatccttattccaaataaagaccacattgatgatcttgaaaaatgtctttcttccatttatgagaaatcaacatggaaaaattacgagatactggtagttgaaaataacagcgaaaagccagaaacatttgagtattataaaaatctttcctggcgttatccaaaagcaagggtgctcacctggaaagaggaatttaattatgccgcaatcaataattttgcagcaaaggatgcaaagggcagttatctgctgttcctgaataatgatgtagaagtcattactccgggatggatcgaagaaatgttgatgatctgccagcagccagatgtcgcaatcgttggtgctaaactttattatccggataatctgatccagcatgcaggtgttgtcctgggaatgggcggaattgcaggacatatcatgtgccaggcatcatgcgaagataaaggatatttcggaagagccgtaaatgttcaggaaatcagtgcggtaacggcggcatgcatgcttatgaaagtcgaagattttgaagctgtgggtggttttgacgaagagtttgtggttgcatttaatgatattgatctttgcatgaaagagcgggcagctggaaagaaagttgtatttacaccatatgcggaactttatcactatgaatccaagtcaaggggaatggaagacacaccggaaaaacagttccgtttcgaaaaggaaacaaaacatttcgaagagaaatggggcgaacagatgagcaagggagatccgtattataatccgaatctgtcactgaaagaagcagactgttccctgagagaagactgagaaatgaggtaggataattctatatggcaagagaaatttttgaggtaacaaaggaccgattccatctgcaggatccatgttgttatattctgcagggcacatggcccaaagaggccaaaatgcgtgcgaaactggacggatctgaggtaaaggcagaaattcagcgactggaagtcgtcagtgcactggaacgatttaaagatccagacctgatgcggggcgagcggatcacagcggctgtacagcttccggaatctctggagggataccagaaacttagtatttatgcggagatgccggaaaaaacattttgctggttttcgatttcagtaaagaatcttgaaaaaagaaggggaaaaccacagttttacattgaagaggaaaaagtgcagcagggatttctgcgtgtccggggatgggcagtggcagcagaaccagtacgtatccagatctttgatgaaaataaagaaaaaatccaggcggaagtacttcgaacggagcgtgtggatgtagaacagctttatgaagagatggaacagatggaaaacaaagacaaatcaggattctttgtggagctgacaaatctaaaaggcaaagttgtttacattgttttttatgccggaaatacaaaatctgtgcatgtggttccgttgcagcagacggtggtgatccggaaaaaaatcgaaaaatatgcaaaaaaaggaatccgttactggaaaacacagggaagtgccgctcttgtcggaaaagttgcagctaaggtcagaacggcatctaccagggaaattccatatcagaagtggatcgtcagacatcttccgggaccgaaggaactggaacgtcagagaagagaaaaatttgattttcagccaaagatttccattgtgatcccactgtataaaacacaggaaaaatatcttcgacagttggttgagacgatcaaagagcagacatatccgaactgggagctttgtctgtcagatggaagtggggcaaattcaccaatcgccggtttgcttgaatcacttgcagcatcggatgagcggattaaagtagtgtctcatgaggaatcactgcagatttctgaaaatacaaatgctgcgattgagattgcaacgggtgattatattgcgtttgcagatcatgatgatgaactgacaccaaatgcgctgtttgaatgtgtgaaggcactgaataaaaacagagatgtgaaggtcctttattctgatgaggataagatgtcgatggatggacataaattcttccagccgcatttcaaaccagactacaatccggatcttctgtgcacagtaaattacatctgtcatttatttgttgttgacagaaaagttattgaacaggtcggaactctccgtaaggaatttgacggagcgcaggattatgactttattttccgctgtatagaggctgtcagcccggaagagatctgtcatgtaccgaagatcctgtatcactggagatgtcatgaggaatccaccgcggaaaatccggagagcaaaacttatgcatttgaatccgggaagcgtgcgattgaagaacactacagaagaacgggtattgacgcagaagtatatcagggagagtttctggggctctacaggacaagatttcacagagaccatgatccactgatttccatcattattccgaataaagatcatattgatgatttgaaacggtgtatggattccattgatcagaaatctacttacaaaaattatgaatatatcattgttgaaaataacagtacagatgatgctactttccagtattacaaaaaactggaagcagagaatccaaaagcccatgtggtttactgggataaggagttcaattattctgcaatcaataattatggagctgcttttgcaaaaggtgaatatctccttctgctgaataacgatacggaaatcattaatgaggattgtctggaagaactgcttggctactgtatgcgcagtgatgttggagctgtcggtgccagaatgtattatgaggatgatacgattcagcacgcaggtgtagtcattggtttcggcggaattgcagggcattgttttgttctgcagccgagaggaacgacaggctactgccacagaatcatctgtgcacaggattacagtgcagttactgctgcatgtatgatggtgaagcgcgaagcttttgacaaagtcggagggcttacagaagaacttgcagttgcatttaatgacattgatttctgtatgaaactgcgagaagccggttatctgatcgtatataatccatacgcagaactgtatcattatgaatccaagtccagaggattggaggatacaccggaaaaagtagcacgatttaataaagaaattcagatttttgaaagacgctggccggatatcatgcgtgatggggacccatattacaacccgaatctgacattaaagagccaggatttctcactgaaacggatataggaggattttgtatgaaagtattagtaacaggtgtaaaaggacagttgggttatgatgttatgaatgagctggccaaaagaggttatgaaggcgttggagtggatgtggatgaaatggacatcacagatagagctgctgttgagcgtgtgatcggagaagtacatccggacaaagttgttcactgtgctgcatggacagcagtagatgcagctgaggataatcaggaagtttgccacaaagtcaatgcagaaggtacggaaaatattgccagaatgtgtggaaaacttgatattccgatggtgtatatcagtacagattacgtatttgacggacagggaacacgtccgtgggagccggatgatccggttgtaaaaccattgaacgtttatggccaggcaaaatacgatggagaggttgccgtagaaaaatatgctccaaaacattatattgtacgtattgcatgggtatttggacttaatggcaagaactttatcaaaactatgctgaatcttggcaagacgcatgatactctgacagttgttgatgaccagatcggaacacctacttatacttatgatcttgcgagacttctggtggatatgctcgaaaaagaagagtatggtaaatatcatgcaacaaatgaaggtggatacatttcctggtgtgattttgcaaaagaaattttccgtcaggcaggtatggatgtaaaagtacttccggtaagttcagcagaatatccggcaaaggcaaaacgtccgacaaacagccgtcttgaaaagaaaaaactggaagaacatggtttcacaagactgccagactggaaagatgcacttggtcgttatctgaaagaaattcagtaaaataattgagaagcagagaataaaagataaaaagaaccggctgctgtctgaaaagacagtggccggttcttgcatgttcgtaagtttgacaggaatcaggatttcgcaacctttacgatgcggaaaaggatcaggagaagcagaagaagtccgataccaccgatcacaaagtatggaacagaagtatgactgactgtataatcctgggcatttgtcagattctgtgtgctggcttcaataacagcagtatcttcttccggtgaagttacagacataaccgcagtgccgaccggagttccattaaagagaaactgacggttgtactgtccatcctgaacttcgccatcctgtgttgtaagtgcatcagcagtagtaccgtttggtacaaatacgtttccaccggatgccatatcaaaatcattatctccaagagaaaggagctggaagttgtcaaatccatagttgagaagactgactgcttcggcagcagttgtgccggatgcaccctggagaataacggcgatcagagaaactccgtttttttctgctccgcagaccaaagtacttccggaagcttctgtgtatccctcgcgtccaccgagacaatactgataataagaagcatttgtattgttcagcatagagaagttgttggtcagtacacgttcaccgccagatacattggtggccggaatcgtataggaagtggtttctgcaatggctcgaaaagattcgttgtcgatagccgcttttgtgatcaatgccatatcatgagcggttgtatgctgattttcgtcaggaagtccggtaggattagtgaatacggtattggtacatccaagttcgacagcacggttgttcatcatctgaacaaatccgtcaacggaaccaccgatctgttctgcaatctgaagagcaacatcattggcagatgcaagcatgatcgcatacagacattgttctacagtaaagacttcatccagctgagcggaaatacttgcaccgccgtccgtgacaccggaaacaccggtcgcggtcatagtaacctgatcgctcagctgtgcattttccagagtcagaagcgtggtcataacttttactgtagcaccggggtaaagaacctggtccatgtttttggcataaacggtagtctgtgtactgtcttccatgatcattgcagctgtggaggttatatccggaccctgtggccagccggagatgctgttggtcgaaatggaagaggtctgcgtttcggccgtttcttcggctgccaggacaggtgtctggaatatcagtgtacatgcaagcccaagagccatcagaccactatataatctttttgatttcataaatctgtactcccattatatttcttatcttaaggtttcaatagaatctatcatatcccattttagcgcttaattcaagcagaatgacatacgcccttgcaaaaacaggggcaggatgataaaatgatatccgattatatataaaaacaaagaaaaataacctgagggtatcaataaaatatgagtaaaaataaagatgtggcagggcatatcgaatggggaaggatgctgaaaaaattaaacccttatacgatcaaaaaaggactgcgttattttaagcattacggaccaaaagaattctggatacgccttcatgaacgttttgaaccggaagaagtaccatatggcccctggtatgaggcctatataccggatgaggcagagcttgagaaacagcgtcatcacagattttcaagtgctccactgatcagtgtggcggttccggcataccggacgccggaaacattcctgcgtcagatgatcgattcacttctggcacaaacttacggcaactgggagttgtgtattgcaaacggcagcccggatgatgaacagatgaaacaggtacttgctgagtatacacagagggacagccgcatacgtgtacaggaattaaaagagaatcttggaattgcagggaacacaaatgcagcacttgcaatgacggaaggtgagtttgccggaatactggatcatgatgatctgcttgcaccaaatgcactttatgagattgcgcttgctctggaaaaagatccggaactggacgctgtttatacggatgaagataaggtgactacagatctgagcgagcattttcagccgcatctgaagccggattttaatctggaccttctgcgctccaataattatatctgtcatttttttgttgccagacagtctgttatacgtaaagccggcggattcaggcaggaatttgacggtgcgcaggatcatgattttatttttcgctgtgtagaggaggccggcaagatcggacatgttccggaaatcctttatcactggcggacgcataaagcatctactgcagataatcctgcaagcaagatgtatgcatttgaagcaggcaggcgtgcgattgaagcacatctgaaacgcaccggtacagagggaacagtaacacatacaccggatctcggatttttccgcgtacagtatccggtccatggagagccgcttgtttcgatcatcattccgaataaagatgagaaagaagcacttcatgcgtgcattgcatccataaaagaaaaaacaaaatatcagaattatgagatcatcattgtagagaataacagcacttctcaggaaatttttgcatattacgaagaactgaagaaagatccgaagattcgagtcattcgctgggaaaaagaatttaattattctgcgatcaacaattatggagcacgttatgcaaatggggagtatcttctgttcctgaataatgatgtgacagttattacagaaggctggttgacagaaatgcttggaatgtgtcagcgcagggaggtcggagcagtaggtgtaaagctgctttatccggatgatacgatccagcatgcaggctgtgtaattggaattggcggaattgccggacatatgttcgtgaatatgccggcaaatcgtaccggatatctgcataaggcttcaatccttcaggacatgagtgcagtgactgcagcatgcatgatgatgaaaaaagcagcttttgaggaagttggtggatttaccgaggaactgtccgttgcattcaatgatgtagatctttgtctgaaggtcagagagactggcagactgatcgtttatgatccatatgtacagctgtatcatatggaatcaaaaacacgaggtgcagaagacagccaggagaaggtacggcgttttcaggaagaaatcgagtatatccggtgtcactggatcgatattctgaaaaaaggagatccgtactataataagaacctttctctttcaaaatggaattattctcttcgtccattgaaaggaatggagttaaaagagaaagaaaacagataggagataatatggaagtatcggtgatcataccgaattttaatggaatcgcatttctggacagcgttttgggaagtctggaagggcagacactgaaaaattttgaagtgatcctggtggataacggatccgcagacggaagctgttcgtttgtaagtgcaaattatccatgggtgcatattattgagctgccggataactttggattctgccgggctgtcaatgagggaataaaagcagcaaaagcaccatatgtactgcttctgaataatgatacggaagtaaaggaagattttgtggagcagatgctgctggcgataagaagacataaaaatgctttttcgtgtgcggcacgaatggtacagtatcatgacagagataagctggatgatgcaggaaattattactgtgcgctgggctggtcttttgcgcggggaaaaggaaaaaatattgatctgtatcagaaagaagaaaaaattttttcagcctgcggaggtgcagctatttatcgtaaaaagatcatggaaaagatcggatattttgatgaggagcatttcgcatatctggaggatacggatatcggataccgtgccagaatttatggatatgaaaactggtatgcaccggatgcagtcgtatatcatgtgggaagtggtacgagtggatccagatataatcatttcaagaccagatattcttccagaaataatatttatctgatctataaaaatatgcctctccttcagatcatcctgaatctgccgtttctggcagcgggttttctgatcaagtttctgttctttgcactaaaaggaatgggaaaagaatacctggccggtatcaaaaacggattttctatcagcatgaatcacaggaaagttccgttttcggttaaacatcttcccaattactgtaagatacagcttgaactgtgggaaaatatgttccgcagaattcgggcataaagtcatttttacagtggtttatggaaatttaatataataaaagataagattttattgattttgaaggacaactattataatataaacgtgtctgtccagacatgggattcagaatgtacgggcagagatgcttaaaatacaatgaaatggatagaggtggcagagattgattcaggacaatcagaagaatttcagtcgtctccagatgttaattgatgccattgtcattgctgtgacctatgtacttgcctggatgatccgttttatcggtccgtttgcatattcagcagtccgggcacttgcgtttgaagagtacatgtttgcattgatatttatcataccggggtatctgcttctgtatcaggcatttactttatatgagcctttgcatatgcaggggcgcagactggttctggcaaatatcatcaaggcaaatgtactcggacttctgctgatcgtattcagtctgtatatgatgggagagtctgatttctcccgactgacggtttacattttctgtgtgatcaacatctttgcagaatggggagtaaggctctttattttctccatgctgagaaaaatgagaaagcgcggactgaatcagaagcagatgatactggtaggttacagccgggcagcggaagaatatattgacagaattcagcagaatccacagtggggttatgttgtcagaggaatccttgatgataatgttccggcaggaactgtttataatggaatcaaggttatcggacgaattgcaaatctttctgtgatacttcctgcaaacaggctggatgagattgcaattacactgggactgagtgaatattaccgactggaggaaattgtcggaatgtgtgagaaatccggtgttcataccaaatttataccggattataataagatcattcctacgaaaccatatacggaagatatactgggacttccggtgatcaacatccgttatgttccattgagtaatacatttaatgcaatggtcaaacgcttgatggatgttgttggggcgatcatggcgatcattgtttcttcaccggtcatgctgctgatgtgcatactcatcaaattgacatcaccgggaccacttatataccgacaggagcgtgtcggacttcataataagaatttctggatgtacaaattccgttctatggaaattcagccggaggccgaagaaaagaaggcctggacagttaagaatgatccgagggtaaccggaatcggtaaatttatgagaaggaccagcattgatgaactgcctcagctgtttaatattctgaagggtgatatgagtctggtgggaccgagaccggagagaccgttttttgttgagaaattccgtgaggaaattccaagatatatggtgaaacatcaggtgcgtccgggacttactggctgggcacaggtaaatggttaccggggagatacctctattcgtaaacgtattgactgtgatctctactatatagagaactggtcgatcggatttgatataaagatattgttcctgacgattttcaaagggttcattaataaaaatgcatattaaagataaggggagagaagatggcaagacctaagtcaaaaacaaaaaagatactatttgctgttgaaattattgttcttctgctgtttatcggtggtctgtatgtatatggacagctgaattcaaaactggacaagatcaatcagccagttctggatgacagtaagatcaaagtaaaccaggaagtacaggattctattgattcacaggaatcaactctgacaggttatacaacatatgctctgtttggtattgaccaccgtgataaaaatactgcactcggcggtgagaacagtgatacaattattattgcaagcgtaaataatgacacaaaagatgtgaagctggtttctgtatatcgagatacccttctcaatcttggtaacgatacttattccaaggcgaacgcagcgtatgcttacggtgaagccgaacaggcgatcacaatgctgaatacaaacctcgacctgaacatcagcgaatatgcaaccgtaaacttcaatgcgctgacaacgatcatcgatgaccttggtggactggatatggatatgtcttatgccgagattgttcatatgaataactactgtgtagagacatccgaagaaacaggtaaggattatacaccgatcgaacttccggacagaccggatgatatcgaggcagttcagtatcattatcatctgaatggtgtacaggcaacttcttactgtcgtatccgttatacagcaagccttgatatgggacgtacagagagacagagacgtgtgatccagatgatcgtcagcaaggcaaaatctgccggtcttggcaagatcttcaagatcatggacgatgtattcccgatggttacaacttctatgacaaaagacgaaatcctgcagcttctgcctactctgatcggttatagtgtagacgatacgacaggattcccgacatcttataagttctctaatgttaagggaagtattattgtaccgacaactctggagacaaatgttatcgaactgcacaagttcctttatggagatgaagcatacacaccatctgcgactgtaaaagcaaacagtgaaaagattcttgaaatcgtcggtggtgagagcagtctggacgataaacaggcaactgttgaagaaaatacaacaaatgacactgttatttttgaaaagaatggaagtggctggtctgatacaagctctgattacggttctgacaacgatagctccggtggtggagactatagtggtgatgagactgataacagcggtggttcttcttctggtggcggagattacagtaatgatggttccgacaacagtggtgatgacagttccggtggcggagactatgaaggaccaacgactccggaaccggattacggcggagatgacaacggtggtggagacaccggcggagatgaaagcggtggcggagacaccggcggagacgaaagcggtggcggagacatcgttgacgaaggcagtggagatgacagtggagcggctgcagaggcgacaggcactcctgatgctgcttaaattcataaagataagacgatagttaagaagggaatttctcattgaagaaattcccttcttctgttaccatacatttataaagaaatatagggagaaattatggaaaatataaaagtggatgtgatcattccggcgtatcatccgggaaaagaattttccacgttgatcgaacgtcttacaaaacagacatttccgatacaccggatcattgtaatgaatacagaagaaacatactggaataaagaactggaagaaaagttttcaatcctggaagtgcatcatctgaaaaaacaggaatttgatcatggtgcaacacgtgcatgtgcagctgaactttcagatgcggatgttatggtatttatgacgcaggatgcattacccgcagataaaagtctgattgaaaatctggtaaaagcactgacagaagatgaaaagactggtgcagcgtatgccagacagcttccgaatgaaaactgcagttttgtcgagaaatacacaagatcttttaattatccggacagatcagctgtaaaaacaaaagacgatctgccggtttacggaatcaaaacatttttctgctctaacgtatgtgctgcttacaaaagggatatctatcagaaacttggtggctttgtaagaaaggcaatttttaatgaggatatgatctatgccggcaggctgatccaggagggctatgcagttgcatatgccgcagatgcaaaagtgattcattcacataactattcctgcatgcagcagtttcacagaaattttgatttgggtgtatcacaggcagaacatccggaaatttttgcaggagtgccgtcagagggagaaggaataaaacttgtaaagaaaacaataaactacctgatccaaaaaagaaaaatatggctgattccgggagtaatacttcagtcgggctgtaaatatgccggctatctgagtggtaaaaactatcgtaaacttcctcgaaaaatgattttatggtgtacaatgaaccgcgaatactggaaggtgtaaaaaatacagacggctgtcaatgaaacagctataagcacacggttttttaaaggagttgtcacattttgaacacaattgattgttacactgttttcataggataaaaaagataaaaagaaaggagcacaggcatggatgatgaaaaaaaatggaatctgaatgctccgcagaatgatacagaaaacaatcgacagaatgagccaccaagatatgaacattattgtatgcatcagaatacagaatcagatacagtgaaggaattacctgaaaagaaaaaaaacaaaaaacgtggcggaaaaaaacttgcagaaacgatttcgctggcagttgtattcgggctggtagcaggtgttgtatttcagggagtgaattttgcgtccgagaaatatctgggatcagacgggaaggacagtcagatagagacagcacagcttgcaggagattcttcggcagatggaagtgattcgaatgaaagtgaaggagctgcttcaagtgaaactgccgcttcggaaacagcagctgctgtgtcacagacgggttctgttgcagaagttgcagatacagcaatgccaacggtagtcgcaattacatctgtaagtgtacaggaaatccccaattatttccgggcatttggatttggttatggcacacagcaatattccagtgagggaagcggttctggaatcattgtcggagaaaatgacgatgagcttttgatcgcaacaaataatcatgtggtatccggtgcgacaacactcagtgtatgctttgtcggaaatgatgtagtcaacgcagaagaggaaacggtggatatgtccggcagcgatggtgatgtcaatgtggaagatgcagtcagtgccaagataaaaggtacggatgaatcaaatgacctggctgtggttgcagttcagaaatcagatataccggaagacacactctcgcagatcaaaatagcgcagcttggcaattccgatgaccttcaggtgggggaacaggttgtggcaattggaaatgcacttggatatggacaatcagttacctccggatggatcagtgcattgaacagaaacatttcgacagatgatggtaccagttcaagcctgattcagacagatgcggcaatcaatccaggtaacagtggtggagcactgctgaatatgcagggagaagtgatcggtatcaattctgcaaagtatgcggacagtgcggtagagggaatgggatacgcaattccaatatccaaggcacagccaattcttgaggaactgatgaaccgtcagacaagagataaagttgaatcagagaatgcagcttatcttggggtcgttacggctgatctttccacagaggcaatacagatgtatgatatgccggagggagcttttgttatccgtgtggagaaaaattccgctgcagggaaagctggtattcagaaaggtgatattatcgtaagttttgatggacagacagtcagcggcaaagatgatctggagagtaagcttgcgtattatgcatccggtgagacggtggatgttgttgtatcaagagcagataacggagagtatgttcagaagacaatttcagtcacgctcggaagcaaaaattaatttataaaaactttagtttacagttttactggttatgttataatgaacgcatagattcgaagatgtagaatgcacttttgatctgtgcgttctttatatgagacagataacaactatgcagaaggagtttacagatatatggcagataaatacgaggatgagattttagagggagaggtcagcgatgacgatgatcaggaagaaaacaagaaagaacctgagaagtactgtacgctctgtcatcgggcagagagtcaggttggtaagatgatcgatcttcctaataatatacatatatgtccggactgtatgcagagaagctttgacagtatgaatcagcagatgcagacaggaaattttaattatggtgatctgctcaatatgccaaatgtcagcatgatcgatctaagcagtttccagaatcagatgggacagcagaagaaacccaaaaagaaaaaagcagaaaagaaagaaccagtcctggatctcaagaagattccggcaccgcataagatcaaggctaccctggatgaatatgtgatcggtcaggaatatgccaagaaggtaatgtccgttgccgtttacaaccattataaacgtgtagcaacagataccatggatgagatcgcaattgaaaaatccaatatgctgatgatcggacctaccggatgcggaaagacctatctggtcaaaacactggccaaactgcttgatgttccgctggcgattgccgatgcgacttctcttacagaagcaggatatattggtgatgatattgaaagtgttgtttccaaattgcttgcagcggctgataatgatgtggagaaggctgagcatggaatcatctttattgatgagattgacaagatcgcaaagaagaaaaataccaatcagcgagatgtcagcggagaagctgtacagcagggtatgctgaaacttctggaaggagcagatgtggaagtgccgatcggagccaacagcaagaatgcaatggttccattgacaacggtaaatacaagaaatattctgtttatctgtggaggcgctttcccggatctggaaaatatcattaaagaacgtctgaataagcaggcgtctattggattttatgcagatctgaaagacaagtatgatgacgatccacatattctggagaaggtgacggtggaagatcttcgaagttttggtatgattccggagtttatcggacgtctgccgatcatatttaccatgaatgggcttacagaggatatgatggtacagatcttaagcgagccacgcaatgcgatcctgaaacaatatcagaagcttctggcactggacgaggtaaaactggaatttgaagagggagcactgcatgccattgcagccaaagcaatggaaaaacacacaggagccagagctcttcgggcaattctggaagaatatatgctggatattatgtatgagattccgaaagatgataatatcggtcaggttacgatcacaagagaatatatagaaggcaatggtggcccgaagattcttctcagaggacaggaagttccgctgctggaaggaaatcactaaatacagagtatatataacatggctttttataaagaaagagaggtaacttatcatggcaaaagatttttttggaagtcttggagaaacacttacaaaaactgcgaaggaactgagcggacgtgcagaggaggtttatgagacccagagacttaaaaacaaaatctccggtgaagaacgacagatagaaaaagcaatggccgacctcggaagaatcatttacaaacgttataaaaaggaaattccggtagatgatgcacagaaagcactttgcgaacagattgaccagcgcatggaacagatcgagaaatataaaacagatatatctgaactgaaggtaaaaaataaacgtttttgtccatcctgcggaagtccgcttgcaaaagatgatgcgttctgttcacagtgtggcgcagcatgtccgactgttgaaccggaagaagatgccggagatgatgtgatcgagggaacagcagaagaagttgctgaagagactgcaacagaggaaacagacgaaactgttgaggaagcaaatgcagatactgctgaagatgcggtaacaacagaagaaacagtagaggaagctgctgaggcagaggaagcagcacagacagatgcagaagagcaaacggaagcagagggcgaaaaagaagaataatgtcagtgaaataaatgatctgaacaaataaaaaagaacaggctgaaatgcaacatcatacagatgcagcgtttcagtctgttccttttatttgtgaaaaactctgcctggattgtggataactgatggcgtctggcttttacaatgtgtatacaaggatgccggcaatgatgatcagattaccgatcagtttcccctttgtgatcttttcgttcaggatgaaacgagaaagcaataatacgaatacataagcggcagtatcgatcacaggcccatagcgcatgtctactttggtataacaccaggtgttcagaagaagaataccgaagaacatcacataggcgaggatgacacgccagttgagatattctcttaaaggattgtcatattttatatttgcactttgcttcagaagaatctgggagattgcggaaaagaaagttcctcccagcatgatcaggataaaagttctattcatatctctgcaccgtccatactccgaataatacgatcaggattccgatgatgttctgtacggaaagctgttcatgaaaaattgcgactgcccagatctgtgaccacagaagatagacacttttgttggcataggcggtggacagtgagaattttttgatgacctgttgccaggcgatcgcgtagattccgcaattggcgatcatcaggaacaggaatacatatagaagcggggcatgcagtccgtttttattgtactggatcgaggcaagttttgaaaaaacacttgtcagagaaaacagcagaatattcagatggagctgcagatagtttctgaaatttttcataattcctccacaatattattttttgaccaatatttattaattttacaccatatactaattgtttacaatggattatgaaaatgatatgataaaaaagaatgcataaatttattgcgtatttagaaagaaagggaaacctatgagtttgtattccgttgttgttcctgtatacaattccgaacacaccttacaggaactttatacacgcctggaaaaagtattccgggaagtaataaaagaagagtttgaactgattcttgtggatgacggttccaaagaccgttcctttgaagtcatgcaggaacttcgtgcaaaggacaatagagttcgcatcatacagatggcaagaaattttggacagcatccggcgcttctgtgtggatttgcacatgtgaaaggtgattttgttgtaaccatggatgatgacctgcagcatcagccggaagaacttccgaagatgataaatgttatgagagaacgcgatgatgttgatgcgatcattgcgagctatgaaggcagacagcatggatttatccgcaaactcggaacgaaattttctgtgtgggcaacttctaagatgctcggcaaagacccggatcttcagatcaccagttaccgtctgatccgtcgcttccttgtagatgcaatggtgaagacaaatacatacctgcctcagatcggaaaccttctggtgctgacatccaacagaatcatcaacgtaccagtacagcatgcggcaagggtttatggaaagagcggctattctttcaaacgtcttgtgaaggatctgatctatgatatcaccgcacatacagcatttccgcttcttatggtgagaaatatcggaattgccagttttctggtgagcatggtcatggcagtgtattttcttgtgcgttactttgcgtttggtgtgtcggttgaaggctggacatccctgatgatggtgatgctggcattttttggactgattcttttgtcgattgggatcatgggaatctatctgatgaatattctgaacgaagcaaagaaaatgccacattatgttgtgcgccgggaggacacggactgatgaaaaaagaaatcggaggctattttgagctggaagattttggaggtaaagagtattatccgaatctttataaagtaaatctgggaagaacagcacttcggtggcttctggaaggccgcggttatacaaaaatatatctgccggtattcttatgcgagtcggtaacggaagcctgcgagcaacgtggaatccggatcagccgttatcagttggatgcggagttaaatgttttgcttccccggaaaaaactgggagaaagtgaatgtctgtatctggtcaattattacggtcaactgacagatgagaagatcctggcatatcagaagatttttggaaatatcattgtggatcatacgcatgctttctttcagaaaccgctgaaaggtgtggataccctgtattcctgcagaaaattctggggagtcagtgatggagcatatctttccacagatgcagtgcttccgatggataagccagtggatcattccaataaaagaatgggacatatccttgggcggtacgaagaaaatgcaggcgtctactatcaggagatgcttcagaatgcagctcggtatgaaggcatggagattcgacgtatgtccaggctgacagagaatctgctgggagcaatcgattatgagacgggaagacgtaagagagaggaaaattatcgtatactttccgaggcacttccgtcagaatttatttttacccgggtgacaccggaggggccatttgtttatccgtattatcataaagaaggccttaagttaagacgctggcttgcagaacataagatttttgtaccgacctactggaaaaacattctcgaagaatgtacagagagcagtctggaatatcagtgggcggcagatgtactgcctctgccatgtgaccagcgttatggaaaagaagaaatgcaatatatggcagaacggatcaaagaatgggaggcagccggagaatgaagcacagattactgatacttggtacactgggcgagtttgtacagcttgttaaaaaatcaaaagaacggggacattatacgatcgtctgtgatggttacccagatggaccggcaagacagtatgcagatgcatcttacgtgattcctgttacggatattgatgcagtggcagagctttgccagaaagaaaaggttgatggaatcataacctctttttcggatctgctcatggaatgcatggtcaaaattgcagagaaagcgggattgccctgctatctgaaaccggaacagctttgctggtacagagacaaatcagcctgtcgggaactgctttcgaagctggggcttccgacgcctggatttgtgaaagtaccggcagcagaacagaatgaatataaacttgccgaaataacagcagggcttaaatatccattgatcagtaaaccgctggataaatatggttcaagaggaattttcatcattaaagatcaggagcagcttgcaggaagtgttcgtaaaaccgcagagtttacagatctggatgaaattctgattgaagaatataatgatggatttgaatttaatatgatgacctgggtttctgatggagcggtgagagtcatcagtattgcagacagagagaaaacacagtttgcggaaggagagcttccggagagcacacgaaatgtgtatccgagctgcctgatcgataaggtggaagaaccggcggtttccctgctgcagtcgtatattgagtataccggacagaaggaaggaccgctttccatgcagtttttctggaaagcaggagagggaatccaggtctgtgagattgctgcacgtttctttggctatgagcatgagctgactgatatggtatattgctttaacatggaagaacttttgttgaattatgtttacgataacgagtatgttacaaagatgttggaagcgcaggatatccgtaaaccattgatgcatggagctgttttgtattttcatgggagactgaaacagattcaggaacaacaggctgcatatgaactcgcggaagataaagcggttgtgaaaccgtggattttctatgaggcaggagaagaagttgtggcgtacggtccgaacccgtatcttgcactgtattatatagaggcaggcagccgagaagaacttgatgagatatcaagagatttttttgagaaaatgagtatgacggatccggatggagaagaaattgtttttcagaataagatacccaagtattctttataaagaaaagtagaggagtcagatgatttattttaacagaccggcacttgtcggtaatgaattaaagtatattcaggatgcagtagctcagggcatgctctgtggtgatggaaaatatacgaagctttgttcagcatggatgaaagaacgtttccaggtaaatcaggttttcctgacaacatcctgtacgcatgcattggagatggcggcattcctgagtgatatccagccaggggatgaggtcatcatgccatcgtatacatttgtttccactgcggatgcttttgtacttcgaggtgcaaagatcgtattcgttgatatccgtccggatacgatgaatatagatgaaaatcttatcgaagatgcgatcacagagaagaccagagcaatcgttccggtccattatgccggtgttggctgtgagatgaataaaattatggagattgcacgcagacataacctgaaagttgttgaggatgcagcacagggagtggatgcttattatcatggaaaggcacttggtacgattggtgactttggctgttacagtttccatgagacaaaaaatttcactatgggtgaaggtggtgctctggtattccagaagaatgaatatcaggaaaaagctgagatcctgcgtgaaaagggaacggacagaagtaaatttttccgaggacagattgataaatatcgatggattgattatggatcatcctatcttccgagcgagatgaatgcggcatatctgtatgcacagctggaagagtgtgataagatcaacaggaaacgtcatcaggtttatgatggatatcatgagagactggaagatctggaaaaacagggaaagattcagagaccggtcgttccggagggatgtgtacacaatgcacatatgtattacattaaggtgaaagatattgctgtacgtacaagactgattgcttatctccgtgaaaatggaattgcaccggcttttcattatgttccattgcatagttctccggcaggtgagaagtttggaaggtttcatggaaaagatgtttatacaacgaaagaaagcgaacgccttttgaggcttccgatgttctatgatctttcaatggatgatgtggattatattgcggaaaagatcagagagtttgagttttgatggaggaaggtaagttgaaacgtaagaaaataagtgcagagacaactgtggaaatcctttttttcctgtttctgctggtgttttatctgatgtgggcacgtgtacagcctatgggtgccgggccggatgagcagatgcgctatcagattgcggattatatttataagcatggttcacttccggtaggggatgacccgtcggtacgaaatgttgtatggggaatttcttatgcattttctccgattctgtcttatatgatcgcagctgtttttatgaaagcagtaagctttgtgacgacagcaccgtttgcgttgcttctcgcagccagattcgtaaacattctgtttggacttggaacagtttggctggtacttgatatgggaaaacggttgtttgaccgtagaaaagcatggatagctgcggcttttgtaggactgctgccaggttctttgtttgtattcacttatgttaactgtgatgcactggcggtattctcaacggcagtgatcgtgtatgcatgggtgcggtatctggatgagggatggatatacaaaaactgtgtgatcctggcattgggtgtggcagcatgtgcattgtcctattacaatgcgtatggatttattctctgcagcatctttttctttgggataactctgtttatggaggcgaaaaagaaaggaaagtatacggattttgtgaaaaagggacttcttgtctgtgtgatcgttctgctgttggctgcatggtggttcattcgaaatgcaattctctatgacggagattttattggtatgaatgcatcaacgatctgtgcggaaaaatatgcgaaaaagaattacaagccatccaatagacgtacaccgcagatggttggatattctttactggatatgttgaattacggtttcccgcaggaagacggattttcctgggtagagcttgtcagtggaagctttgtcggtcgttttggaaatatggatgtgtttatgccgaaatggctgatcaacaattatctggactttattaaagcgggatttcttctgatattcctgcatccggtgaagacttttgcaatccgtgtgaaaaaacagtggagtgtgaaggggattttcaactggtgcatgctggctgcgatgatcattccgaatatattgaatgcatattattcttatgcatcggattatcagccacagggacgttacagtctgccaatgatcgtgccgcttacgtatttcatggtaatgggatatggaaatctttttgatgtgcagattaagaaagagagcctgcgtaagaagatttatgctgcaatctgtgtggcactggctgtactggcaatttttgtgttctttggcgtgatctggccggaatataaggaggtgccgttcagtatcagggcgtttatatatggatcataatgtataaagaattcccggtgacgggaagtaaaatgattgaactccagagagggatgaattttctctgtgagttatcctctgtacttgtctcagttcagaacttctgagatatcaggatatacaagaattttgctaagggcgatacagaaaagagctgaactcgctgcgctcagacagcagcattttctgtatcaacgcaaaatcgtgtataatccgatatctttacgaagttcttcaggcgagacagatacagaggataatcacaggcagttcttcccttactggagttttttgtttttatttcaatttcaccggactttattgtgggtagtgtggcgggggtcgggagagaaaacaggaatagagcgaagtgagaagtattaattaattttttgtaatgtctattgaaaaagagaagaacaaatggtactataaaagcaaagcatattttctataatttcatggcatctatgccgtctattttcttaattcatttcagaaatccatgcttttaaatccaattgaaaagaaaagcaggggttttgagtgataaagataacagtgttggcattctatctcctgcgagaacaggaggtgttgcctatggcaaaaaacaagaagacacgtaaagttacagtaaagaagaaacaggctgctaaaaggaatcagggaatgcaccgtgttccgagagcgaacagaaagtataaggatacagtatttcgaatgttattctcagataaagagaatctgctgtcactgtataatgcaatcaacaggtctgtatatgaaaatccagaagatttggaaatcgtgacattagagaatgcaatttatatggggatgaagaatgatctggcgtttattatcgacacaaatctgtttttgtacgaacaccagtcaacatataacccaaacatgccacttcgggatctgctttacatatctgcggaatatcagaagatcgtagatcataagtctttatactcatcggtgttgcagaagatacctgctccgtattttatcgtgttttataacgggacagaaaaagaagaagacagatgggagaattctttatctgaagcatatgaaaatctgactggagaacctaagctggaattgaaagtaatcacattgaataactgtgcgtcgcattctcgttacttcagtgatgagttagacgcactatctttttgaaaataaggataagttttagaatgaaaatcgacaagaggttatagaacctctgccgattttcttttttataggaaacagcagaaaagaagagcgtgcagagcgtaaaaactctgacacgcttattttttttaccataaaagcaaatgaggacggaaaggagcatagaacatggcgaaacgaaagtacaagcgtctgcattacgaggacaggcagaccatagaggctatgagtaagcagggcagcagtgtaagcgatattgcagaggtactgggaacacatagggacacaatttatagggagttcaaacgctgcaacaccacactgaaaacctacacagcagcagcggggcagcaggcattataaggaaaggagtaaaacatgggtataacagttttgagtttgtttgatgggataagctgtggaatggtagcacttgaaagagcaggaatagaggtagataaatacatagcttacgaaatagaacataatgcaatagaaatcagtaaaaagaattatccagaaatcgtacgagggggggacgtaacaaaggaagattttacaaagtacaaaggaaaaatagacattttaattggtggcagcccatgccagaacctttgcagttgcggaaatagaaaagggttagagggagaagaaagtagactgttttttgattatgtaagggctttgtacgaaacagaggcaaaatggtttttattggaaaataacgcaaccatgacaaaagaaaaccaagacataattacaggcattatgggtgtagagcctatttatataaattccaatctattaacggcacaggaaagaaaaagactgtactggacaaacataccagacattaagcagccagaagataagggaatttttcttagagatatagtacagccaagagaagagaaaaaagagtacgagtgctataagcggatgatggcaaaggaagagggaacattagcacataaaaaagcatggtcgcaagttaaaacattagaccaaaaaagtagagctttaacaactgcacagaatataagcaattcgggtgcgacaaatataaagtattcagatacagagtattacatactgacgcctttagagtgtgagcgtttgcagacactgccagacaattacacagagggggtaagtaatacacaaagatataaagctattggaaatggctggacggtggacgtaatagcacacattttcaaatatcttaagaaagcaatagaggaaaatatagagccagtcaaattaaaagaccatgaacgcccacagcaatcatacagaagaatggtaaatacggaagagaaaaaaacagaggaaaaaacaataaatgcaaacgaggtaatagaaatgcaggaaaaggagaaatacgaaaagaagatagcggaattagagagggagctaaaggaaaaagacaaggaaataagcaaaattaggggagaaatgcagaccttaaaagacagggtatttaacattttattagaaaaggcgtgcggttgataaaaccgtaccatgagtgccgttagttcagtggttagagcagccgcctcataagcggcaagtcgtgggttcaaatcccacacggcacattgtgtagcaggcatggcgagcctgcggcagagggcagcaggctaatagctgcaatctgtataccgtgaaaaaatagcggcggtcataccagccagaaagtatgtggacggtcaacaggttttcagttgctttttaatgtgaaaagcagcccgcacggtaaaaccaaacgccagaacaggagagcggcacacatggaaaggcagagagcgccgccgaaaggaagagaggcagacaatggcagcacaggcattgatagtagaggacgcataccagaaaggctacgcagatgcaatggaagatatgcgaaagaaaaaagagcagaggcgacagcgggagcaagaaaagaaagcccgccgctggtatttcattaagcagaaagcctatgggtttgtaatgctggcagttaccgtgctggcagtatgggcgacagagggcgacataacaatagcggttattaccgtaccgctggggcttatgtgtcttttcggtaaaaaaatgctgatagtagacaactactattttgaggcaaaaaaggggtagacatgggaataacaaggacagtaacaacgcgggtacattgcgacgtatgcggcgagtgggtaacaggctgggaaagcgagggtataggaataagcagagaatgggctaagtattttgtaaggctgcaaggctgcacagctggaaaaaggattatatgcaaagagtgccgaataaagcagcgtattaaaaaatgcagtttgcagaaaaaatacggcgtagccggaatggacggcggcgcttgtctgggattttcatacgacggggacgacgagcctatagaacgctgcaagcgttgcatagcctgcacaagttttgactgggaagaggaaaaagaaaggctgaaactatgagaaaacagaaacgacagacagttaaaaaactgatgcagtgcgcagccattatagcggcaggcgtgctggcgatcattttgtttatgctggctatctggtacagaggaaagaacagcgagccagtaacagacgaacaggtagcagcgcagatgcagcaggcagagccgctggttattgaaacaccagaggcagccgcagagggcagcataagagtatacgactatgacggctgctgtatttatgcctactacggcaaaattcggataaacaacgacggtaaggacggcaaggacattgacgtagaggcaataggatacttagagggctaccaagaacataaagaggaaagcggggcgggggaatgagccacaaatattacagccctttacgcccgttatcactggggacatttccaaagcagcagggaaacgagattttacatatagaaaattttaaggaacggcagaacgtaccagagatagcacggcaggcatggggatacattgagtacaaagaggcgcttacagaaatagaggcggcagcttatgagttgataccgtcaaactgcatttctgaaatggaaaacttagaggcaaggagataaaggcaatgagcgaggtatatatacgcagccagaataaagaaaagctgtatagactgggcggtaattacgcctgcgtagagtatggagagtacgaggacataaagaaaaagagaggcggcgcagaggcagacaaaaagcgccacgtaatttgcataagtgacgggtgtttagaagaaattggagagtatgccacaaaagagcgctgcttagaggtgctggacgagatacagaaagcgtgcgtaagctatctgtttacggctggcggtgcagcagtaataaggggcggcatggacgtacagccgtttgcagcagtaataccgaggttgtacgaaatgccagagaagtaggagaggcagacagtgacagtaaaggaatttataggcacgctggagagttcagaccgcctgcgcattatcgagggcaaagcagaggtttacgtagggtatctggcagcgttcaaaccgtttgcagaccatgagataagcgaggaataccgaaaatacagcgggcatgaggtaaagaagtttagagcagtgccggagataacgcacagacgctggaaagagctggggcttatgaaaccattagagccagaccagacagcacagtataagtttagtgatttgcagatgtcgctttactacaccatttacatataagaaaggaaagggcaggaagtatgacaaagaaaaagccggattttttacgggatttagatactgcaatcatggacgagcttacaggtggcggtatcaagggaaatgcagcgggactggtaggaacgcttacacagattaaggaaattaagcagctatgcgggctgccgttttgtggttatatggcaaagctggaaacggtaagaccaagcggcgtgccggacgaggtaacggtagtatttgcagaggacgtaccatacaggacttgcaacggcatagaatttgacgttatgcaggaatttgtagagggcagcaggcttttactgacaggtaaggtgcagacacttaaggacttccagagcggtagactgctggtatatattctggcagattttgtggcggtatcggaaaaggcagtagagcaggacgaggcagcagtaagaggcgttatagcgaataagccaacatacagagaaacaccgagaggcaagcgcattactgatattacggtaaaggtaagaaatgagcttacaggcggcagctgctttttaccgtgcatctgctggcaggaacaggcagacgaggcggcgcagtggcagcagggcgacactgtagagctgctgggacggtatcagagccgtcagtatgaaaaggtgcttgatgcagccacaggagaaagagaacagcgcacagcttatgaggtatcggtacggctgattagaagaaaggaagaggcagaaaatgagtgttgaacatatcggcaagggctatgtaaaaatctgcgtgagtgaggaagagttagagaacagcatagctgggcttagccagttaaaacctattttgcaaacgcaagcaataaaagggaatggaagaaacacaaagcaggggcttattgacgcagcagagctgggaaaacattttgatacagcaatagatgcaatgactatgcttttggctgggtttaaggaagaaagcgaggcacagaatgaagagtaaaacaattttaggagcagacggcgcaacaaaaatgcggcagattacagtagggatacacggaaagggcggcgaggcaggcataaaggcaatacagcagcttgcaggcatggtggacagcttaaagcagtgccagacaccacaggaagtatacgacagatatttacagattacggggtactgtaaatgctgcgttgattgtaattttatagacgcaaagggagcagacgagctgatgtgcttagcagcatatctggcaggaaatgaacaggaacgggcagaggcacaacagaaagcgggtaaaaaggcatgagaaaggtttatatatgcagcccatacagggcgaaagacggcgcagagctggacagaaacatagattatgcgcagcagctgacacggcaggcattagaggcaggcttagcacccattacgccgcatttatatatgacgcagtgcatggacgataaaaagccggaagagcgggcaaggggcatggctgctgggcttgcgctgctgaaaggctgcgattttgttattgcgggcgtgaaatacggcataacagagggaatggacagagaaatacatacagcaaatatgctgggaattgcggttatagatgcaaaccagattaaacggcatctggaatatgaggaaaagcgacaggagcgggtagcgagcgactacgcaaagctgcataagtgcaagcattgttacgagcgtagattatgtagccttatggggcatgagaactgctgtaccgccagcgcttgcacagctgcatataaacgggcttatgagtatgccttaagccgcataagagagtggcaggaaacatgaaaaataaaagcgcctacggtggggaaacaccataggcgctaagctatacagctttgaaatactataaaaattataagctatgtatggcgcaaagtcaagaaatttaacgggcaagcagcccgctttaacacttgataaaagtattaacgaaccgacagagaggtagatatatgccatacgtagagagggtaacaaaagcgggaaatacgatagagatagagaggtactttaccagcagatacaaaaagaaaggtatcagcagaggagataaggtaaagccaacaaaagaagagcaggaaaaagtaaacaccagacaggcagagagaaagttaaggatactcataaatgcaaactatggctatggggactaccatttagtgcttgactatatccgcaggaaaggagagccggacagaacgccggagcagatgcggcaggacatagacgtatttttgagggagtgcagaaaggagtacagaaaagcagggttagagttcaaatacatacacgttatggagataggcaagaaaggtgcgaggcatcaccaccttgtagtaaataaaattgatacagagattttacaacgctgctggtataaggcatacgaggggcataacagggttaaagtattcccactggacgatagcggcaactatgcagatctggcaagttatttaatcaagtacacaggaacgcacaaaaagggtactgacggagcattacagggcaagcgctggaattgcagcaagaatttagtaagaccagaaccagagtaccacataatttcagaccgtgagtatttcaagaaagagccaaaggcaataaagggctattacgtggataagaacagcgtgagcatgggagtgcatagcccggagtattacggctatgggtatttaagatacaccttagtaaaaataacagataaggggggctgaaatgcagataatcaagggcattgccattgcagcagtgttgataatagccggactgctggcgctgattgtggcagcatatctggcgtttagaattgcggcggctatttttgaacagcaggagagctggaaagacagcggcagcagaaagggcagaaaacatgatagaaaaaattaaatactggttattccagaaaggcaaggactgtaagcgctgctgcctgcggtgtagatactacgatatatgccgctgggacgtattgggaaatgcaggactacaaagcgaggaaacaataacgcttttggcgatagagaacagcaagccgcataaggacgggctgcttttcagaatttgccagtatgtagaatttaagcagagagcgaggcgagaaaatgagaaactttagactggacgacgaaagcgggcatcaagaggcattatttagctgggctgcatacagaacagagattatgccggaactgcaatatatgtatcatgtgccaaacggcggcaaacgtgataaagcaacagcagcggtgcttaagaggcagggcgtaaaggctggcgtgccggatattatgctaccagctgcaagggctgggtatcatgggctttacatagagcttaaggcaggcgagaacacgacgaccaagaaacagaaagagtggttagagtatctgcggcagcagggctattatacagccgtctgctacggctggcagccagcagcgcagctgatagagcagtatttattacattcagacgagcttacaaaagagcaggaaacagtaaccatgcgttagaggcgacgcaggaaagagaggcaaagaatgaaaacaataagcattttgaacttaaagggcggcgtagccaagacttttacagcggcaaacatggcgtatgagctttacaggcgaggttataaggtgctgctgattgacaacgataagcagggaaacttaagcaaggcgtacagcagatatgatgcagagaacgtagcaccagccacaaggctactggctggggactgggaaaacgcagacgagctgatacagcatacggagtatgagggtatcgacattgtaacggcgaatatgtcactatttggggctacatggaatttaaccaaagaggacagcgaaaaccagatagagagatacaaagcgctggtaacagcgaaagtgctggggttcgggtatgcaaaatttgactacatagaaacagagcgggcgtatgattactgcatcattgataacccgccggatattgggcttaatgttgtaaatgcgctggcaatcacggacgaggtaatagtacccgtaaaggtggacgaggatgctttagaggggctggacattgtgacagagcagatagaggacgcaaaggcgtttaaccagacattaaagctggcaggcgtactgattacgtcataccagaacacagacggcgaggcagcaggcgtagagtggctggaacaaaagacagattttaatattttgggtattattcggtattccaagaaagtagcagaaaatactttcatgcgtaagccgatttatgagtatagcccatgctgcggagcggcgcaggggtacaagaaatttgtaacagcgtatacagggaaagcgaggtagcaagcgtggcacataaagagagagtatgcgcttactggcattgcagcaggactggcggtacggagtgctggaactggggcagcagatatgcagggaagaaatgcccgcaaagcgacgcttgcgagcattggagaacgtgcgaaatgtgcaacggagtaatgggacagtgtaagaaaaaacaaaggattgagaaagcgaggtagattatgacagctcttgaaatggtttttagcatctggctttttctgcatagattaaaaagcaaagtgcgggctttatcagaaaatgagtttaaccgtatgctttatgacgacggcttaacctatgaacagaaaatatatttgatttattttagatacatttagggaaagagaggctaagaaaatggcaaagtttggtatcaatgacattctgaacgcaaagacgaaagcagcagggcagcaggcacagacagagggatacaaagagatttatttaagcccttacgaggtaaaggcagcgcaggagaatacgcaccaaagattagagaacatagaagagctggcagacagctttttacacgtaggacaggaacagcctacagtattggcgagagtaaacggggaataccgtataatcgacggacacagacgtaatgcggcaaatattttgaacttagagcgggggcataaagagtatgagaaagtgctttaccgctttatggacatgagcgaggcaatgtatgagctgcgcttattggctggcaacggatatacgcaggaacttacagcctatgaaaaaaccagattagtagagcgtaccaaagcggcgcttatcagagccaaggaagaggacggcttagagatacagggcaaaatgcgtgatttagtggcggctatgataaatgagagcagcacaaacgtagccagaatggacgcaatcaacaacaacgccacgccggagattaaagagcagctgaaagagggtaatttaggtatcactgctgcatacgaggcagccaagctggacgaggacgagcagaaagaaatagcggaaaaagcagcagcgggcgaaaatgtgagggcaaaggaaatagcggaaaaggtagcagagaaaaaggcgggggacgattacgaaacaccgcacccagaaagcataacatctttgtgctattcctgccagaaatacaaggactgcaacgtaaaaacgggaacgtgccagaaatgtgaccagtacataaataaggcagaggctgaaaagacagacgaacagcgatacagcgaagagcaggacgctatagaccgccagacaaagaaaaaattgcaggagcgggcagacacagaaaaaatggagcatctgccaagtgaggggaatatagagcataagcaacatgaattaaagatagtggcatcttattacgaggacgtaataagcgggaaaaagagctttgagctgcggaagaatgacagaggatacaaacagggcgacagccttaaaatgctggaatttaaggacggtaagcacacagggcgcacgattgatgcagatattatttatatgctggaagattatacagggcttacagagggctactgtattctgggtatcagagtaacagactatacaggtaaggtgtccgaaacggacacggaaagcggggcagagcatgaatagacggcagcggaaaaagaagaaagcacaggtatttacaattattctgggttgcacggcgttttgcaaggcagagcaatatgagaagatgcggaaaagcgtagaatatcagttacgaacaggcagcgtggttatgctgcctgcatacttgcacgtagaggcaataataaagcagcgaggcggcagaaatattgagattaagcaggaaaacggggtagtaaatgtttgagtatatggacggcatagtagatgcagtggaagaaattggacaggcagcagtagacgtagcggtatttgtgacgatatgcacagcaaaagcggtgttgataataacagcgccagtatggatattgccgtatgcgatatggagaaaggggcgtaagcagtgaaatacagacagtggaaaaagaactacaagaaaaaacatggagtaaacccgccgttagagttggacaagcgaaaacagcgcaggcttgcaagaaaaagggcaaggcagataaataaaacattgccaacagcagcagaaacattgacggcagctattaaccgctgggcgcagagtataaagccagcactggcgacattatgcgagaacgtagcagcggcgtttagcaatatggcagcaggattgagagaagaaagcgaggcggtagaaaatgactaatattttactgggaattatagcactggaattgctggctatattttcaaagctggacaaactggaagagaggggcagagagaatgaataacgtatcacttacagggcggcttacaagagagccagagcttagatatggcgggcaggacaatagcacagctattacccgctttacgcttgcggtagacgacgggaaagacacagattttataaatattaagtgtttcgggcgtactgcggaatgggcgcagaaatggttaagcaaaggcagcagggcagaggttacgggcaagattaaaacaggcagctacgagagccagcgcacgggcagcaaggtatattacacagaggttgtggcaaatagcgtaggatttggagagagcaaagcagaggcagaggcaagagggcagcagctgccggagagtgacgggtttatgaatatcccagagggagcagacgaagagctgccgtttaattaacagaaagcgaggtacagaacatggagcaggaagaaacaaagacaacagcggcaacaggggtagaaatgccgccagaggctgaaagctgggtacagctgcacgaaagcgaattaacagagatgatgcagaaacaggcaaaggctgcaataacggaactgaaacgacaggaaaagcaggagcgaaagaaagagaaataccacaacacttttacgcttatgaaatgctaccgtgatgcggttttccatatcgagaacgcaataagcgacgggcagcagttggagcttaagggtatgacggacgagcagcagcgtacatacttagagagtatcagacgcacacgctttaagacattgataatgacagcgcatatagacaaagcggtagaagagatagagcgccgcagagaggcagcaggcagaggtgtagagtacaaggcttttgaaatgtatttcatgcagggcatggactatgcggaaatcgcagaggaactggatacaggaaagaacacaccgaggcgctgggttacgggcatcataaacgagctgtcagtattattgtgggggattgacgaagagagggtaaagtaagtgtttgaaaaaataaaagcatggataaaaagaaagcgggaaacagcgagagaacagcaggcggcagacaggttgataaagcatatagagcaggcgttaggatttgagctttacgagtggcagaggttatatataataactgggatatggcagccgccagagggacggctacacggaagaacgacagcatatatattgcggctattattagaccagagtaagccactgctgctatatgagttttcacaggtggcagcgtatgcggataacccatttatggggcggcaatatcagccagtacccatgcagtatgcaggctggtttaggcacgagataaggagtatatacgagcagctaagagcagcaggcgtgccagtaagagaaatgataacagagcagcagcgggtaatatcgtggtaaaaacgtggtgtttacatgggaaaacaaaagagatacaatggtagcatgaaatgagtaggcgatagcttaagccatgtgcggcagcagttgcctactctttttctattcattctttagcctccacccagcgcatgaaacttagggcgctggggaatgaagaaagagaggggacggtatgaaagcatgggctaagagtttttatttatcagcggcatgggaaaaaaccagagccgcttatttaatgtcacaagattatatttgtgaacgctgcgggcagcccgcaaagatagtgcatcataagcgctggcttaacagagagaacataaacgacataagcgttacgttgtgctgggataacttagaggcgttgtgccaagactgccacaacaaggaacaccacaaacaggagaggcataagcggtatcagttcgacgagaacggcggcatactccccccatatcagaaaaataattaaagggggcgaataccgagggggataccctaaaattaccctacgggcgtgcgcacgggtggtgtagggggtgtggtgcggcgcaggaatggaaagcggggtaaaggaatggcaacaaagaaagagaaaaccaaagaacagaggataaagaccgaaaagaccagacttaagggaatttttaaggacttagacgaaaacaaaagaaaattagtaacgccgctgatagaaaaggctgcatttatgagcattgagctggacgacttgcaggcgaaacttgaaaaagacggctggacgagtgagtaccagaacgggcagaaccagtggggaacaaagaaaagcccagaggcagaaacctacatagcgcttagtaagaactatgcagcagtgattaagcagcttacggaattagtaccagctgcgaaacgaaagacaagcaggctggcggctttgcgggaagagtaagcaatattgccgccttatcgaaattatatctatgagtaccacgcaaagattacaagcggcgaaatcatagcgggaaaatggataaagaaaatatacgaaatcattataaacgggctgcaaaagcaggagtatttttttaatgcaaaggctgcgaataaggctatacggttcatagagaacttttgccaccacagcaagggacgtaatgatttaatcaagttggagctatggcagaaagccatagtttctgttatttttggcatacaggacgcagaaaaaatacgtattttccgtgaaatttttattgtaattggcagaaaaaacggaaaaagtttatttgcatctgcgattattgcatatatggcgtacttagagccagagtatggacaagaaatatactgcttagcgccgaaattagaccaagcggcgctggtgtatgacggattttatcaaatggtacaggcagaggacgagttagcggagctggcaaagaaacggcgcagcgatatttatattgcggagagcaacacggtaataaaaccgattgcttttaatgccaagaagtcagacggatttaacccgcagcttgtggtatgtgatgaaatggcagcatggagcggggacgctggactaaagcagtatgaggttatgaaatccgctttaggcgcacgtactcaacctatgatattgagcataagcactgccggatatatcaacgacagtatttatgatgaactaatgaaacgtagcacaagtttcttgaaaggaaacagcaaagagcgcaggctattaccattcctttacatgattgatgatgtggagaagtggaacgacatagacgaactgaaaaaggctaaccctaacatgggcgtatccgtaaaagaaagtttctttatggacgagatagcagtagcagagggcagcttaagtaaaaaagcagagttccttacaaagtattgcaatatcaagcagaacagctctattgcatggctggaatatcagacggtagagaacgccggagtagaaaagaccttagaggactttagggactgctacgcagtgggcggtatcgacttaagccagacaacggacttaacggcagccagtgtggttattcagaaagacggtacactgtatgcgtttacacagttctttatgccacggggcaggctggaatacttacaggctacggacggcgtgccgtatgacatattcgttaaaaaggggctgataaccttaagcggcgagaattacgtagattaccacgacgtttacggctggtttactatgctgctggaagattacggcatacgaccgttgaaaatcggctacgacagatacagcgcccagtaccttattaccgatatggcaaattatggttttcacatggacgacgtttaccaaggcgaaaaccttacaccagttatacgggagtttgagggcatcataaaagacggcgattttaagattgccgacaacaatttactaaagacgcatttcttaaatgttgcgcttaagcacaacatggaaacaagaaaattcagacctataaaaatcgagcagtgggcgcatatcgacggctttgtatctgtcatagatgcaatgaccgtgcggcagaaatactgggaagagtgcggcgagctgcttaaaaatgccgcatagaaaggagtgtaaacggcatgaaatttttagactatctttttcatggcaaagaattaaaagccataggtaattatttcaaaatgctgaacggatacagcccgacgtttaccagctttagcggcggcgtgtatgaaatggatttgaccagaacggctataaataattttgccacacattgcagcaagctaaagccggagatagagggcagcgcccttaagtcgctggaaaagacattgcagcataaacccaactactttatggatacaacaaaatttataaagcgtctggcaacgtatgtagcggtggaacacaccgcttttattatacctatcgaggacgaatacgggcgcttatgtggctggtatccgctgcgggctgaacgctgcgaggtggtagagagcgagggacaattatatttacggtatctgtttgcaaatggcagctatggagctattgagtttgagcgtgtaggcattatgacagactttgaatataaagacgaccttttcggagaggacaacagcacgcttgcaccaactatgcagttgatacatacgcagaatgagggaattataaacgctgtaaaaaattcggcaaatatccgctttctggcaaaggtggcaaatatactgaaaccagaggatataaagaaagagcggaaacgctttacagaggataacttaagcgccgacaacgatagcggcatgattatttatgataacaagtttagtgagctgaaacaggtagaaagcaaaccgtatacgccaaacgcattgcagatgcagcacatacaggaaaatgtatgcacgcattttggcacaaatatggatattctgcaaaataaatttgatgaaaatacatggaatgcttactacgaggggaaaatagagccgtttgcaatacagctatcgcttgttatgacaaatatgagctttacagagagagaaagagcctgcggaaatgctattttcttttctgcaaaccgcctgcaatacgccagcaacgccacaaagttaagcgtaagcacacagctttttgaccgtgcgctactaaacagaaacggcgtaatggatatatggaacatggcacacgttgaggacggggaaaagtattatatccgaaaggaatatacagaggtaagcgaactgcacaaaggaagtgagcagccagttatcatacagcaagtaccgcagcagacagaaccagcagcgggagaagagccgtagaaaggacaggaagagaaagagggtgtaaataatgccagttaagaaagaacgggaatatagaacgctggtagcgcctctggctgcgcagagttccggcgaaaagcgcttacagtcggagtgctacgtagagggctacgctactacatttaatgcgccataccttttatatgagtttgaggacggcacaaagatttacgaaagaatagacgcacacgcattagacagcgcagacatgagtgacgttatcatgcagtacgaccatgagggcagagtatttgccagacagtcaaataatacgctgattttagagctggacgtaaaggggcttttcgtggcagcagacttaagccggacagacttagcccgtgggctgtatcaagacataagcgcaggaatgattactaaaatgtcatgggcgtttacagtggcagaggaaagctacgacagagaaacacatacaagaacaattttgaaaatcaaaaaggtttatgatgtatcagccgtgagtattccggcaaataacgatactgaaataagcgcccgtgcttttgcgagtaggagttatgagcgggagcggcaggagttgcttaagaggcgggcagcaatactaaagattaaggcgagcttataaaaatcaaaacaaaaaaggagaacacagactatgagattaaaggaaattgaggcaagattagccgaaatcaaagaagagcttaacaccagagcggcagagcttacggacgaggaaattacaaaactggaaacagaggtaacagacttacaggaagagcgtaccgctttactggcagcggcagagaaacgtaaaaagctgcttgaaagaattgcagcaggagagccgacaggtggagcgggagcagataccacgctgcttagaaatttcaagggagcaggcggcgcaggagcaggagaaccagaggacaaatacgacactacggcatacagaaaagcgtttatgaattatgtatgcagaggcgttgctattccggcagagtacagagcagctgaaaccaccaccacagcagacagcggcgctgtgattccgacaactattatgaatgaaattatccagaaactggaaagctacggcagcatttatgcaaaggtgcgtaagattaacgtacagggcggcgtttccattccgattgcagacttaaagcctactgcacactggattacagaggcaaagagcagcgacgaccagaaagcatctgctaaaaattccgtaactttcaattattacggtttggagtgcaaaatttcccaaagcattttagcaaatgtagtaacattgaaaatgtttactgatttgttcgtacctatggcaacagaggcaatggtaaaggctatcgaaattgccattttcaacggtacaggcgaggggcagccgctgggcgttctgaaagacagcagggtaacagctgtaattactctgacaccggaagagtatgcaagctggaacggctggcacaaggtaaaaggcaaaatgaaaaaggcgtacagaaacggcagctttgttatgaaccagtccacttttgatactggcattgacggcatggaagataagaacgggcagcctatcggacgcacaaactacggcgtgaacggagaggaaacataccgttttatgggtaagaatgtggaaactgtagaggacgacgttttaccgagctgggacgacgcaaacgagggcgacgtaatcgcagtatttatgaatttctctgattacgttatcaataccaacatggaaatgcaggtagtgaaatggacagaccacgacaacaacaagattaagaataagtgcttaatggtagtggacggcaaagtagctgacgctgcgggcattatcttagttaaaaagggtgtaacagcagtgtaagaaagcgaggcagagcatgaaaggatacttagacgcaaaagagctggaaagctataagaaagaggatttgcaggaactggcaaagcagctgggcgtagatgcagagggaacaaagaaagaaattgctgcacgctgcgcagccgtcgaggtagacataccagacgacaacgagcttacggaagaggacaaaaaagcagcagccgaggcagcagcagaggcggcagctaaagccgaagaggaaaaggcggcagccgaggcagcagcgaaagccgaagaggaaaaggcggcagccgaggcaacagcgaaagccgaagaggaaaaggcggcagcagaggcggcagctaaagccgaggaagaaaagaaagtagcaaggctggtaaaagtgaaagtaaagcgccgtttccgtgatatggaattaaaccagattaaggatgctggggacgcttacaccgtaagcagagaacgtgcagcagttctggaagaggcaggcgtagcagcagtaatagaagagtaagaaagagggtgcaggctgtggcagcagataccacaacattaaccgagaaaatgcgggcggcgctgcgtatcagcagcaccagtgagaaaatcacagaggaaataaacgactgtatagccgcctgcaaagctgatatgaaaaacgacggcgtaaaagtgataaaagagacagacgggttgattatcagagcaattacactgtattgcaaggcagagtttggttttaacaatgctgcggaacaatttagaaagtcatacgacgcacttaaaatgcgcttatctttatcagcagaatacaacacagcgccgcaagtgtccgaaacggacaccaacagcacagaaagtggggtgtaaagcggtggagtggctggacgaattaacacttattgcagaaacaacagcagaaaacagggtaaataaaaacggctttgcagtaaagccggaagaaagcccccgcactgtattctgcaacaaaaaatcagtagggtacagtgaatattttaagagccagcagacaggaaaactggtagaggcaaagtacgaggtacacaaggcagattatggcggcgaggacgtagtagaagtaaacgggcggcgctattttgtacttaagacctacgatacaggaacagacaccatagagcttacgcttacagatttacgccacagaaacgaggtgtaagcatgggagagtttaacacagtcgggctggaagatattatagacgctttcagccggagagaggcggctacagttgaggcagtccccaaaatgcttaaagctggtgctgatgtgctgatagaggcacagagagcagaggcacaggcaatgggactgaatgaaacgggcggttttatcaattccataaaagctacgggcgtaaagggcgacgatacggagaaatacgtagagatatacccacagggacgggcaaagcatggaaacgacagaaaaggagataaaagcaaggtgcgctatgcaacaatcggctttgtggcagagtacggcacaagtagccacgctgcacgcccttatatgacagtggcaaacgaaaaggcgcacgaaaaggtagtagaggcacagcgcagtatatgggagagtgaaacaggcgaatgagtatacaggagattttagaaagcgcagggttgccagcccagagaggcgtttacactggacgggataagccagacgcatattatacgtttctacggctgctgggtacgcctgcggtaaatgcagacgacgaagagaaagagcgcagggaaatgtatagagttacgcttttccataagggcgattttgaggcacagcttgataagacaaaagaggtattgaaagcagcaggcgtttatatcaacagcatagacgcagaaagctacgaaacagaaacggggtactggttagtgcctatcacagtcgagattttgaaagaggagtgattaaacaatgacactgggactgaaagatttatattacgccgtatgcacagaggcagacggagcagagagctacgggacacctaagaaaatggcagaggcaatgagcgccgatttatccgtaaagacagcagacggcagcttgtatgcagacgacacattaagcgagagcgtcacggagtttgcaagcggaacgcttaagctgggaattaaagaccttacgccggaagtgctggcagagctgctggggcaggcagtagataagaacagcgtagtatgggcgggaaaagaggacgagccgccgtatgttgctgtagggttcagagctaagaaaacgggtggtaaataccgttacgtatggctgcttaaagcaaaatttaaagtaccgtctgaaaagtacgaaacaaagggcgagagtatcaagtttaacacgccggacattgaggcatcttttacaacaagaaagaaagataacttgtggaaagcagactttgtgggaacagaggaaagcgcagcggctaaaacgtggtttacagcagtgccggaaaaggcagcagcaatggaaagtgtataaaacaggaaaggagagaggcgtagcatgggctgcgccttaattttatatcatgggagcattaaagagcggggcttttcccgtagagctgaacggcaaagaatatggtttacttttttcactgaacgcattagacgaagtgcaggaaaagtttgggggctacgacaaattaagtgaggtattcaataaagataacccaaacctttttaaagatacaaggtggttacttacgctgcttattaacgaggcacttttagcagaggacgaaaacgcccagctgcttgaagagaagagggtaggcagactgatacacgcaggaaatttgcaggaagtacagaacgctatttttaaatcgttctacagaggaactgcgggagacaacagcggcacagagaacgaaaacgacggagaagaaacaacagaagagggaaacagggcagccgtgcaggaaaattagatactgcacggcttttgtatattgcagtagtgcttttgagatacagggaacgtgaggcatggagaaaaacaccataccagataacgacactgtttaaatatcacaaggaatataacccgcacattttccgacaggaacaggcgggaacatcagcagctacagaaaacatggacgatatagacatagcgttagggggcttttaattatggcagataagacgcagaacgtcaaaacaaggttaagttttgacggagaggcagagtataaagcagcctgcaaggaaattaacagcacccttaaagtgcttaattctgaaatgaaacttgtaacggctgaatataaggacaatgcaagcagcgtagatgcgctgaaagcaaagcaggcggtactacagaaaacatacgacgagcaggcaaaaaaggtaaaagaaaccgaggcggctttagaaaaatgtcgcaaggcaacaggagacaatagcgaagaaagtaaaaaacttgaaacccagttaaattaccagaaagcagcgcttgtaaagacagagcaggaattaggcaaaacgactgacgaaatggaaaaagcagaaaaagccgctgacgaaatgggaaaggaaataaaagacagcggggaacaggcagacgacgcaaagggaaaattttctggatttacaagcgtgctaagcggaatgggtacagcgcttaaagcagcagcagcggcgacggcggcagcagttgcgggagcggcaacagccataggagcgcttaccacaaaagcgatagagggatacgcagcacaggaacagcttgtaggcggtgtagaaactcttttcaaaacgtcgtctgatacggttgttggttatgcaaacgacgcatataaaacagccggaatgtctgcaaatgagtacatggaaacagttaccagcttttcagcgtcgctgcttgccagtatgaataatgacacggcagcggcagcagaaaaggcaaacgtggcaattacggatatgtcagacaatgcaaataaaatgggtactgatatatcgcttatacagaacgcctataacggttttgcaaagcagaattataccatgctggataacttaaaactgggatatggcggtacaaaagaggaaatgcagcgactgcttgatgatgcaagcaagctatccggcattaagtatgatatttcatcatattcagacgttgtagacgctattcacgtcgtacagacggaaatgggcataacagggacaacggcaaaagaggcaagtacaacaatagagggttcggttagttctatgagttcagcgtgggacaactgggtagctggaatggcagacagcgaggcgaatttctcacagcttacaagcaatctggtagacagtattgtaacagtggtagggaatatagcaccgagggtaatagaaacagtgccgaggctggtaagcggactgggagaaatcgtagagcagcttgcaacgtatataccacaggttatacaggagttattaccgcctttaatgagcggcgtacaggacttgcttaatacgctggttggaatgctgccggaaatgataagcataatcgggcagattataccgacaatcatagatacgctgcttactatattaccgcagcttttagaggcaggcgtacagattattacggaattggcgcaaggtatcgcacaagcgttacctacattgctgccaacaatcgtaacggtggttacgaacattgtaaccatgctgatagaaaatataccgttgctgattacagcagcattacagctgcttacggggctggcacaggggctggtagcagcgctgcctgtactgattgaggcactgccggaaatcataacggctatcataaatgcactggttgagggcataccgcttattattgaaagtgcgggcgatattatagttgcattgattgacggcatcatagatgcaataccgcttttaatcgcagccataccgcagattatagcagccattgtaacaggactgattacgggactgcctaagattttgacggcggcaggcaagctggtaacgacaatcataaataaaataaaagagctacctactctgataccgcaggcaatcgctgcgggcgttgagaaaatagcagagtggggcgcaaatatgcaggaaaaaggcggcacagttataacaggttttgtaacgaaagttatagatattgttaaggagctgccgcagaaaatctggaacagtatagtaagcgcagtaaccagagtggctacgtggggcgcaaatatgcagaccaaagccaaagaagtaatgaacacaatgcttacgaacattgtaacgattgtgaaagaaacgcctgctaaaatctggaacagtatagtaagcgcagtaaccagagtggctacgtggggtaacaatatgcttacgaaagccaaagaggtaatgaacgccatggtaacaggcgttattacgattgttaaggaactgccgcagaaaatctggaacagcatagtaggggcagttaccaaagtggctacgtggggcaacaatatgcttacgaaagccaaagaggtaatgaatgccatggtaacgggcattgttacgattgttaaggaaataccgcaaaagatttataacagcatttctggtgcaatttccaaagtggctacatggggtacagaagtaaagaacaaagccgtagagggcatgagaaatgtaattactggaatagcagacgtatttaaggatattggcagtacgtttgcagggttcggtaaaaacatggtagaaggcatctggaacggcataagcggcgctacgaggtggataaaagacaaaataagcggctgggtaggcaatgttaccgacttccttaaggatttatttggaattgccagcccgtctaagctgatgcgtgacgaaatcggcgtatatctggcgcagggtatcggcgttggcttttctaatgaaatcggcggcgttaagaaaatgattgaggacagcgtaccgcaggagtttgacgtagacgcaaaggtaaatgtaggcaatgaatttaagtatgataacgacgacaaaaagccaaagccgagaggcggcggcagtgcagcaggcggcgtagttgtcaatcagtatatttatgcgaataccacggactatgcaaaacagcagaaagaggcagcccgacagttcagaatgatagcaaggacggtgtaacacatggaaaatgaaaaactgacttacataaattcaaggggcgagcggttagagctgggagtagacagcgtataccattgcaatataagtaaagacgtagagggcatttccggcgttacgagcgtcatttacagcacaaacagtatgggacagcacggcgacacttacgtagggcagcgtatcgaggcgagggacatagacgtagtgggacatatcaacacacgggacaaggcgcaggcattggaactgcgccgccgtatgcttaagatatttaacccagagcttagcgctacgctggtgtatgagtacggcggctttaagcgtgtgattgattgcagggcgtatggagagcctaagatactaaagaaagaggtactttatgagtttgatttacaaatagagtgccttaacccgttctggcgggaagaggaagaaacaaaagaggatatagcaagctgggtggctgcgtggcatttcccttgcgttatcgaaaaggacagcacaaagagcatgatatacggataccgagcggaaagcgtaatagtggactgctacaacgagggcgacgtatcaacaggaatgaggataaggtttacagcactggggacagtttcaaacccgatactgcttaatgtggataccgaggaatttatacagattaacgccactatgaaaacgggcgacgtgatagagattaacacgaagtacggcagcaagggcgctaagctgataagggacggcgtagaaaccgactatttccgctacattgatgtagacagtacatttatgcagcttgccataggcgacaatatgtttagatatgatgcagccagcggcgtaaattctctggaagtatccatattctacagcaaggaatttttaggagtgtgacggtatggagcttagagtattcgacaagacagtacagccgctgggagctatagacgagctggcaagcctgctatggcatacaaagtattttgacgtaggaacttttagcctgcttgcgccgattacggacaataacagccgtttgctgttagagggtaacttaataaccaagcacgacggaaaaaaggaagtaaagaccgccgacggcggcgtatggcgcagggcagcgcagataacctacgtacacattaccaaagacgagaacggcttagagcagttagaggcacaaggctatatgcttagctggtggcttaataagcgctgcatttatccgcagattgtggcgacaggtacaaaccagtatcttataaaccttatggtaaagaacaactgcggcagcgcagcaggaacaaagcggcgttttccattgcttacatttctggcgcaggaaaccatagacggcgtggcggttgaatatgcaaacgaggtatacgcacaactggggcaggaagtaaaggcaagggcgcaggctggaaagctgggctatgacattctgcttaacgaaagagagagactgtttggcttttatctgtataagggcaatgaccttacagccacaaataccgagggtaacacaccctgcatattttcaagagattttgataatgtcaacgagcaggaatacacagccagtatagagaactgcggcaactttatttatgtgcagggagcagctgacgacgacggcagccagccagtaaccacagtggacggcgagggcgcaacggggctggatttagtagaggtattctgcgacgctacggacattgccagaaagtaccagcagggggaaacagaggtaacaataccgctgaatacctatattgcaatgctgaaaacgagaggcggcgcagagttggaaaactacggcaagaacataaattttgtaagtaccataaatacaaattcaaacttaaaatttaaggctgattttgatttaggcgaccgtattacttgcaaagaaactaagtggggcatacagatagatgcacgcattacagaagtaacagaaacataccagaaaggcgaggaaaccatagaggcgacttttggcgacagcctgccgacgctggtagaccagattaggaaagtgaggtagcagaaatggcaaacagcttaccgtttaatgccgtggcagtagacggagagtacgacagggtatataaagccgaggattgggcgtggtactttgctactttcattgcaaacggcatttttccaaagccgagcgacgggctacaggtagtagcttacagcggcatggaaataagagtaaatgcaggctatgcctttataaacggctacgcctttagaaatcctgcaacgcttagcgtaacactggatacggcagagggagcgcttaacagggtggacagggtagtagttcgctgggatttgccgcaaagagatatgtatattgcggtgctgaaaggcacaccgtctgcaaagccgacagcaacggcagtaacacgcactacggaaatatgggagcttgcgcttgcagatatttacgtaggcaagggcgtaacaaggatacagacgcagaacatcacagaccagcggtttaatagcgcagtctgcggcattgtaacaggaacggtggaagagatagacgcaagcgtgcttacaaagcagtttacggactttttcaacacctacagcgcagccgtgctggacgagttcagcgcatataagcagagtatggaaaagtaccttacagagattgcgggcgtatatgacagctacgtaagcaagacagagggcttatttgcgcagtatgagagccagtttaacgaaagatacagcagttttgaaagcacgcttgacaactgggacaaggaacttttaagcgcctatacagaatttatggcaaaaattaagctattccagtcggacgctgaaaacgaatttaacacatggtttgagagtatcaaggacaagctgggtgaggacatagcaggcagcctgcaactgcaaattgaagagctggcagcagccatgcaggaagtgaaaaagcaggcagaggcaggcacgaaagaaaccaaagaggcaatagcagcgctggacgagcgacttaagagagtagaaagcggctggggcattgactataagcatgatgctgtactgggattgtgttacatgggcgcagcatacatgagccagcattacgaaagaacagtagaaacggcagtgttaggggctacctacgtgggtaattcctatcttgcaaatacattttagaaaggcggcagaccatgaaaggatttcctaaagtattaaagacaaaagaggattattacaactgccttgctatggtagcaagcggagaactggcagcagcagatttgctggcgaaaatcgagagcgcagagaaccagcgttatattgagtgcggcgtagcagctgtagaggaagagaaaaaggcggttacggtatattactgcgacgaggcagcggtaggtatgaaatttgtagcaggcgacgtatccggcacggtgcagggagtaacacatatccagaccgacgaggcagcggcagcaggagaggcgggaaacgacagaacagcccttacactttccaaagcggtaaaagcgggctgcaaggtaattgcgctggaacgcacagacaccgtggcaggaatgacaacagacgacattgcagcactgaaaggagtattaaagcagtatgagtagattattagtggacgacgttacaaagaccgacgcaagggcgcttttgaacgtaaataaaatggctacaatcagcgatattgtagcaccgagcaatgagtacatttacgccagcggagcaaatgagctgaccgtagtagagggttgcgtaattgccgtgggcggcgctggaattttcaagacagcaaatacaattcttacggctgctaatctggacgcaggcagcgcttttgcggtaggtaaggactattacgtatatatctgcgacagcagaattgacagcgcagacgagaaatacgtaatttcccttaactctacatacccgacaggctggaacgctacaaacagccgtaaaatcggcggctttcattatggacgctgccgcaaggtggacagcaatttacagccgcttaatggcagcagtgttatatttggcacaggctgggaaagtgcagtaagcaacggcattgtaccacgttctgtatggacactgggacaccgcccgaaatgcagcccagagggtatggtatatttaggcggcggcacatgggtagatatttaccttaattctgacgacggagcaaagggcttgaaatcagagtacggctgcgcacctatgacgggtacagaaagcatgaactggtacaactttgtagaacgtctggcaaagagcggtaaacgcctgccgaactatgcggaattttgcgcttatgcttttggcagccctgccggactggataacgcaaatacaaacgcatggagcgccaccagcaacacaggtaggggcgtaacaggcagtgtggtaaatgccgtttcttccgtgggcgttgtagatgccgtggggcgtgtctgggagtggctggacgagcttattacaagagcggaacacgccacgaatgcagactaccacgcaagcatagcgtggggctgggacaagaaaagcccattgaacacaggcgagaagtcttacgacgttggtaacatttaccagtattacgcatattctctggcggcgctgatggcgggcggcggctggaactgtggggcgaattgcggcgctcgtgccgtgatttgcagcggttgcccgtggaatgtcaatacgggcattggcgctcgtggggcgtgtgactctctgtagacggcgggcgaaagcccagccggataaacggggggtaaggcatggacatacagacaaaaacagatattatacaccagaaaatatacgattttctgctatatatttaccctctgcttacgaagtacccaaagtatgagaaattcagtttacagacggcgacaagaaacgcaattcttgaaatgctgcaagaggttataaagtgggataagacggcaacgaaaagccacttatacacggtagatacggcattgcaggaaagtaaagaattgctgcggctggcgcatgacttgaagtatagcgctatgaacgcacgacactacggcgagagctgccgcaagctgaaagaaataggcgttatgctgggcgaactgatagaagaggtaaagaccagaaaatagcaggatatggggcagctgcttacttacagcctctggcggcgctgatagcgggcggcaactggaacaatggggcgaattgcggcgctcgtgccgtgaattgcaacaattacccgtggaatgtcaatacgaacattggcgctcgtggggcgtgtgacttagtgagaacattacaggcacagagttctacggaatactggcaaggacttagaaagggataagaccgagtgtttaatatcctatagtcagagtggctgtcccgccgtgaggcaaagagaaaaaatacggctgctggttagtagctacggcgaaaggcaggagcttaatacttgaagagagtaggatacattaccgataaggacgggcggcgcattacgcttttagaggctatgggcgactatggaaacgtacagaaagcctataacaaagccagaaagtgtaaacgccacagaaaagacgtactgatttttacgaaagacaaagaggaaaacttagacaaggtgcgggaagatattataaaccttgcctatgagccaagcaaataccattactttaaggtgtacgaaccgaaagagcggcagataatggcgctgccgttctatgacagggtggtacagcacgccataaacaacgtgttagagcctatatttgataagcggtttatatcgcagtcttacgcctgccggaaaggcaaaggtatgcacgctgcgtctgatacgctaaaagagtggctgtatgagtggaacaaataccacccagaccagccgctttatgctatcaaggcagatatacaccactatttccaaagcatagaccatgcggtattaaaaactgaaatacgtaaggttataaaagacgctggggtactggcattgctggacaggataatagaccacaacggcaatatgccggacggcgtagggataccagtaggaaaccttaccagtcagttatttgcaaatatctatttggacgcattagaccagtttattaagcatgagctgggcgtagaggcatacatacgctatatggacgactttgtaatattaagcccagacaaggaacagctgcgcagctggcttgcacggatagagcaattcttacgggaagagcttaagttagagtttaacccgaaaactaccatactggcagcaaagaacggtatagactttgtaggctacaaacacagggcaacgcacaggaaagtgcgaaaggacagcataaagcgcataaagcgtactatcaagaagtgcgagagcgggaaaaacacaaaagagcagttacaaaagagcatacagagctggacgggacacgcaggacacgccgacagctacaacctacgaaagaaaatagaaacgctggcagaggcagccatagaaaaggctgcttaagcggcagaatgcaggagcgagtacatgagtagcaatttactaagggtagtacaagaacaacatgaaaccatagaaaagcaaagcaggcttattgctgatttaatagccactctggaaagctgggagcagacagcgggctacgacggcgaagagctgaaagagcgggcaaaagatttgcaattaagagaaaggcaggatttatgaacatgactattacagaatttattgaggcggcggcacataacaaaattatccagctggtagtattggcgattgtgtgcgacacggtttttggcgtgctgcgtgcaatcaaagagaagaaatttaacagctgcgcaggcattgacggggctatcagaaaagtaggtatgcttatttctctggtattcatgctggcaatcgacgtactgattaagattaacttaatcggatttataccggagcaggcacgtacatatttagggcttgataccgtgggcgtggctgaatttttcgcattgctttacattgcctatgaggtagtgagtatttttaagaatatggcattatgcgggctgcccgtaaaaaaggtatgggaaaaggtgcgggagtttctggcgaagtatacggacgaactgccggacacagacgaactggacggggacagaaccacaggcaacgtagaggaacacaggacacaggaaagataagaataataaggacatagcagcaaagagcgcttgcgggacaccgcaggcgcttattttgtatgcggaaaggcaggaaatatgaacattaacagaaagataagtaagtacaatttcaataagggcagcgtttccagaattaagtatattgttatccattatgtaggcgcactgggcggcgcagaggacaactgccgatattatggcggcggcaatagaaatgcgtcggcacattactttgtaggatttaacggcgaggtatggcagtgcgtagaggacgctaatatagcgtggcattgcggagcgtcgagctataagcacgcagagtgccgaaacgctaatagtatcggtattgaaatgtgcgtaaggaagaaaaacacaaagagcatgggcgcaacagataaagactggtattttgaggacgcaacagtagaggcagcggcagagcttacccgttaccttatgaataaatacggcgtgcctgcatctcatgtaatcagacattacgacgtaacgggcaagatttgccctaacccgtatgtatataacaccagcgcccacacatgggacgagtttaagcgtaaaatcagcggacaggcagaaacaccgcagggcggcaatgaaaaaacaatctggaattttcttacaggaaagggcttaaatgcttatgctgtggctggtattatgggtaatctgtatgctgaaagcgggcttatgccgaacaacttacagaacacctataacaataagctgggtaagacggacgcagaatatacagcagcggtggataatggcagctatggcaattttgtaaaggacagtgcaggctatgggctggcgcagtggacgtattggagcagaaaacaggcgttgcttaatcatgcaaaacaggcgggcgtatccattgcagaccttaatatgcagctgggctttttatgggaagaattgcagggatacacagcagtaatggacgcactgaaaaaggcgggcagcgtgcgtgctgcatctgatgccgttcttactggatatgaaaagccagcagaccagagcgaaacagtaaagaaaaagcgtgcagagtacggcgagggatactataaaaagtatgcagcaggaaacggtacaaagtattacagagtgcgcaagagctggacggacgcagcaagccagctgggggcgtttacgtcactggaaaatgcaaagagcgcttgcaaggcgggctatactgtatatgatgataacggcaaggcggtatataccgcagcagggcagcaggcaagcgtaggcgttccgtttagcgtacaggtagatattttagaccttaatatcagaacaggagcaggcacgaactatgcaaagacgggagaaaccacaggaaagggagtatttaccattgtggaagtgaaagccggacagggtgcaagcgttggctggggacgcttgaagagtggcgcaggctggattagcttagattatgccacaagattagcttaagtttttgagggcgggcggttcgctgtctgccctctattttttgcaattttataggattttctgcataaaagcgttgacaatataccaaagttggtatataataaaatcatggaaaggagataagaacaaataagaggcaaagccactggaaaggagaaacggcacaatgggtaagaaaaagaaacaaaagaaaaagcctatcgaatggcgagacctgacaatcaacgcattgatagacttaatcataggcataatacttatcataatcggtaagtacataggttagggcgaaagccctaaccgacaggcgggcgataagcccgctgcctataaaaaatataacacaaacccacagccgagtaaagagtatgcttttgaaattaggagtatttttagtagtagtaggactggtaaagctgcttattgctttcgttttgagagcaaaggaaaagagaggtaaggcatgaacttaggcgagaacataaggaaagcacgaaaagcggcgggcgtttcacagtcagaacttgcggaacgcctgcaagtccaccagaaagatataagcaggtgggagaatggggcgcacgcaccgacaatagaaatgtttgcgaaaatatgcagagagcttaacgcctctgctgatgaaattttagaattgaagtagatacgaaagcgagggcttactatgacaaagaaaaaggtaattttagtggcagcggctgcattatttgcagtaagcggtttaacggcgctgccgtctggaaatataacaggtggggcgggctgcattgtggttgcggcagtatgcgcctattttggactgaaaaagaaaagcgcaggaaaagagaacggaaacagaacgccagcgcctgccgccgcatctggtagcagggttttagatacaatcagaacgaaagtagtaggcgtgacgttcaataatgaggacggagaaaacaggcaggatattttaagcagaatgtccggcagtgaagatattacagtagaaaagtacacatacaacggagagcctgccgcatacgtaaagtggggcgataaggtaataggcaatctatcggcagagctggcgggggacttagcaagaaagtacccgaaagcccgctacaccgcagaaatactggaaatttctgggggggggtacagacgttcgggtgcaatatagagcttgacgtaatcgaggacgcaacgcccagcgtaagccagcatacgggagaaactacagtatatgtagaccgtagcaacaaaaaataccatagtaagcctaactgttcgggaatgaaaaacccaaagagcataccgctaagccaagcaaagaagaaatacaccgcttgtaaaaagtgttgtaaataggtaaaggcataagccgcagacttgtaaaagagtttgcggcttttcatcgtatatggggaaagaacaggaacgaaagagaggtagcagaaatggcgaataagaaaggcagccgacagctgacatggacagaccgtataagtattgaggcattgaaaaaagcagggcatagcgtgatagagatagcagaacagctgggcgtacaccgcagcactatatacaatgagcttaagcgaggggaatatatgcacagaaatagcgactatacagaaacattaagttatagcccaaacaaggcacaaatgaaagcagaggaaaatttaaaggcaaggggtacacagcttaaaataggaaacgatattgcatacgcaaattatatagaggataaaatagtaaatgaagattacagcccagctgcggtactgggagaattgaaagcacaggggaaagagggggacttttccgtaacagtatgcgtaacgaccttatacagctacattgataagggtattttccttaagttgtctaataagaatttgccagtaaagaagaataagaagagaaattataagaaagtacagaggcaacagaaaagggcggcagcaggagagagtatagacaaacgcccgaaagagatagatacacgggaagagttcggcaactgggaaatggacagcgttttaggtaagcggggaaagtcaaaaaatacgttgctggtactgacagagcggaaaaccagaaacgagattatatttaaactgccagaccatacagacgaggcagtagtagcggcactggatagattagaaagaaaatggggcgctgatatgtttaagcgggtatttaagacaatcacagtagacaacggtagcgagtttgcagatgcagagggcttacagcgttctattatcaacgagggagaaaagcggacaaaggtatattactgccacccgtacagcagttgggagcgtggcacaaatgaggtaacaaataagatgatacgccggaagataccgaaaggcacaaattttgacgacaggacagaggaagaggtagagagtatagagaactggataaacggatacccacgcaaaatacatggctatcattcagcaggggaactattcgaggaagaggtaaagcagcttgcataagaacggaaatagggagcgtgagaggttggcagcagtggcagccttactattgcgctgcctaaaagtgaaaatatacaataaaacaggctacgtattgtgcaaaacggcaaaacgataaaaacatgaaaaaatgtcgaatttaatgttgacatttttatttttgaaaataagcagaacaaatgtttgtaaattctatttgcatatggtataataaaaacatggataaaaatatgtttaatatcaataataacgaattttcatatggtagatgatatgtgtattccctgcagtaccatctggtatggtgtacaaaatatcggaaaaaggttttaaaagatggtattgatacagaatgcaaggaaatgctctatgactttgtagaagaatataaattccagatcctggcaatggaggctatgccggatcatatccatctgcttgtagattgcagaccacagttttatatctctgatatgatcaagatcatgaagggaaacattgcccggcagatgtttcttgcgcatccggaactgaagaaggaactttggggagggcatctgtggaatccatcttattgtgcagtaacggtgagtgacaggagcaggaaacaggtatgttcttatatcgaagggcaaaaagaaaaacagtaatcaaagaactcgttttttatatttgtaagaaagaggaaaaaagatgaggacagtatccagttatggcgtagaactgcgaaaacagaatatcccgatccgccagacactggatatttaccgttctgcggtcagctgtctgattgagatctatgcccggatatgggatgaactggcagtgatcacggaacctaaaaaacgtttcaatactgcagaacatctggtacataccactaaaaagaacgaggcaaggttcgattttgacctgcgatttccaaagatgccttcttatctcagaagggcagctgtccagcatgcgctgggaagcgtatcctcatataagacaaggctgagactgtgggaaaaaacggatcagaaaggcggcgggccgaagctggtgtgtgataatcatgctatgccggtattttaccgtgatgtgatgtaccgtgaagatactgaggaaaaagatggagcgtacctgaaactttatgacggccatgactggaaatggttccgggtcagtcttagccatacagacatggaatatctcagaaagaactgggcaggaaaaaaagctacagcacccgtgctggaaaaaaggtatcgtaaatacttcctgtgtttttcttatacggaagaagtgccgcttacaaagacacctgtaaaagaacagatcatctgcagtgtggatttaggactcaatacggatgcagtctgtaccattatgcggtcagatggaactgtcctgggaagaaacagaaaaatggaaactgaaatctgtgacagtcagcagggagccatccggaaaatattttgccagtcttttgttttgctgtgaaaaccaaacagcagaaaaaagaccagcagaaaaatttattgggatcgattttgcgatgcagggaatgtgtgtgttttctactggtaaaagagctgaatatccgatgttttatcggaatacagagaaaaagcttgcacgggaacagagaaagctgtccagatgtcagaaaggcagtcagaattataagaagcagaagaaaagagttgcactgtgccatgaaaagatccgaaatcaaagaaaagactttcagcataaactcagtgccagtcttgctgagagcttcgatgcagtatgcgtggaagatctgaatctaaaagggatggcaggaggacttcatcttggaaaaggtgtacatgataatggatatggcctgtttctgtctatgctggaatataaactggaggaacgaggaaaatatctgatcaaagtagaccgttattttgcatccagtaagatttgcagtgtatgcggaaagaaaaaagaagaattgtctttagctgataggatttattactgtgaatgcggtaacagaatggaccgtgatgtaaatgcagcagttaacatcatgaatgagggaaaaagaatctttgcagaatgtgcatgacagcacaataagaagtccgtaaccggactaataaaaatcgcggggcacgcgagggtagcttgtagatacttggctcagtagagccattgagcaagaagcccccacttcaaaatcagagatttaagtggtgggagcatgtcaccggacattcgcctgatgggaacaggcagaaaggagtgtttatggaaacttataagagagtatttgtgatcgttctggattcactggggattggagcaatgccggattctgagaaatttggcgataagggtgtggatacgttcggacatatcctggataagatgggaactttggatattccaaatcttcagaaacttggaatgttgaatctgcataagggtggtacgatggaaggcgtggaaaatccgattggccgctatatgcgaattggggagaccagcaatggaaaggatacaatgacaggccactgggaaatgatgggaatctatacacagaagccgtttattacttttacagaaaccggttttcctaaagaactgatcgatgaactggaaaagagatgtggcaagcgtgtgattggaaataagagtgccagtggaacagaaatcatagaggaacttggtgaggaagaaatcaatacaggagcgatgattgtctatacttctgcggattcggtaatgcagatctgtggaaatgaagagacatttgatcttgccaacctgtatcgctgctgtgagattgccagggaactgaccatgaaggatgagtggagagtcggcagagttattgcgagaccgtatgtcggaaagaaaaagggtgagtttaagagaaccagcaaccgccatgactatgcgttgaaaccgactggaagaacagccttaaatgcattgaaggatgcaggtcttgatgtgattggtgttggaaagatcaatgatattttctgtggtgagggaattacacagacttaccattcagacagttctgtgcatggcatgcaacagacgattgagatttgtaaagaagattttcatggcctctgctttgtgaatctggtggattttgacgctttgtgggggcatagaagaaatccggaaggatacggacgtgagattgagaagtttgatagtggactcggaactctgatgaatgagttgcgagaggatgatcttctgatcctgactgcggatcatggaaatgatccaacttataccggaacagatcatacaagagaatatgtaccatttattgcatattcaaagaaaatgaaagaaacaggagctattgagaatcaggatacatttgcggtgatcggtgcatctgttgcagaaaattttggggtacagatgccggaaggcacgattggaagatcaatattgaaggagttgcagtaggtaaataaaactgctggtggggagaatatgggcgaactgtatttatatcagaaattccccttcttaagtcagaaaaaaaggagctgtctgaaatatattttcggactgctccttctttttactacctatcgaatgcctttgaaagtgacagttttgcgcatccctcgtttcaggaataattttttataatttttggcctgttttcttggaacatagactttcatttttgcaggtgttcctttaaaggcatttgaaccagtgtatttctgcgataatcctggagattgaatgttcagtgttcttaatttcttacatccgtagaaacattgctttccaattaaccgaacggatcttccaacttttacagaagacagtttagggcatttatagaaagcataatttttgatctgaacaacgttatttccaatggataccttcttcagatatttgttgtttttgaaagctttgcttccaacagaggttacagtgtaatccagaccattgagtgtaatgcggtccggaatattaataacactcgattttttatttacgggttttgtatactccagagtttgagtgccggttaccttatatatgccattacttgctgtatgtttgacaggcattccaactgggtaaggtcttggagctggagtactggtaggctgtggcttcggaaccggagtatttgttggtcttggagtcggagtgttagtcggaaccggagtatttgttggcactggagtacaggtcggcttcggagtcggggtgctggtcggcttcggagtcggagtgttagtcggaaccggagtatttgttggcactggagtgctggtaggcttcggagtcggggtactggtaggcttcggagttggggtgctggtcggctttggagttggagtgttagtcggaaccggagtatttgttggtactggagtacaggtaggcttcggagtcggggtactggtaggtttcggagtcggagtattggtcggctttggagtcggagttgtgactccttgagcagaatcatagaattctacttgcgcggtgtaggatttctttgtaactccgtctggtgcagttaatgtataaatgaccggattggtaaaatcatgtggggttccactccaaaaggcagacggaagggaagtaccgtaactgtagccaaaatcaatagatggtttcagggcagttacatttgtgccttttggcagccggagaatgatcgtgtccgttccaatctctccgatgacatcctgtttaagttccgggttatccgaggcacgcagtacgaaactgtaaaattttgcttcactggaagcaagtacatgtaatacaatttttaccgataaggtcgcttttgtctgagtatcctgaacggtgtacagtgactcgtaagtgccgacaggagcagtaactgttcctgagtaatagaaataagagtaactggaactgtcaggtatattatttcggctcagtccggacggaagattctcgctgacaacggttgtcttgtacttgccactgccgccggttacgttgccggaataagcatattgagtgttcttggttctagtgcacagatgaagctctgtatctgtgatctgcagaggagccagtacactgagagtcgaggaaactgcagttacagttccatactgtcctggtaatatatctgtagcataaaacagaagagagcttccgctgtctgaagcagtcataatatgctctttgtcaatcgcagtaacatttgaagcagcgccaagtgctatatgaattccataggtatccagagtatcagtagtaattattggagaaagggttccattgctgtaaacaatctgaagctttattcccgaaagatccagcttatctccgatggtgtactgagtctttgatggcgaagaaagaatattcagttttgttggtgtatttgctgcaacagaaatcttctgtgttacttttgcaccaaaatagtcaaaagtaacttctgtatcagaagaagtcagcgcacgcgttttatcataagtatatccgctgtaaatataggcatagcgaccgcctatggtagcaaagaagctgacaccggatggattgaacagatctccctctgtataggaaagtctggatggttttgctgatatctggagacttgtaatatcacttgtttttggagcaacgacaggaagtaaataactggtctgtcggcctttgtatgttacagtaatctggcaggtatgtgccgatgtattatcaaaaccgctgaccatatcccgcgtaatggaaactttcgttttgttgtttataacaagcgttccgaagctccatggtgtttcaccaatataacaggaggacggagtatattttacagaaagtgaagtaatgtctgaggaatcggttcgagccgggattccatcatcagacattttccagtcagctccaaaagaccatccctggtaagaggaagaatccttcatctgtgcatctgtcagcagaccaccggttgaaggtactgcagcagtagaaccgaccagatttccagatcccgtttttccataacagttcaggatgtgaccatttaatccggttgaagaatttattacatttgcagctgcaagaccgcaaatttgtccaacaaaagaggaaccaccggaaactttaatctgaccggcatgcagacattctttgatcacaccacccataccactgaatttttgggtttcaccggcaataccaccgacataaagaggataagaagtgccgttttcctgggtgacagagatgattccattgctgacacacttttctattgtaccaatatttaatccggcaataccgccgacccagcctttcatagctggcatagacagatttatattcaggcgggccgtacacccactgatgattccggcaagttcgttctgaccggcaatgccgccaaattcaggaaagaccatggatccatcgccacccatatgtccggtgaccgtgccggaaacagaacattcctgaatctttccctgattatattgtgcaatgacaccctgtacattctggctgtcatcgtcaaaatcagctacaattcgcagattttcaatggttccgtcattttgggcgataagcggttttttcaatccgtaaatagtgtgtgaattaccatctaagtgtccactgaaataatttacagagaaattaatatttccatttgtctgaatatctttggtcagactgtaataagcacccggatgatccgagataaggttcaggtcatcgagagaagtgatcttatatggatcagaggcagtaccactaccttcagatggagctgcagaagtggcgcgatttccgacgatacggtaaataatgctggagcttccgttggcaggaaccgtgaatttcccatttttcagttttataatgactgcagaagctgcaggcagcgtatagttctggttactgtttccggaaaaaacaggaaatgttgcagcctttccggcggcaatacggtcaccagagaaactgtaattgccgtagagatcgccggcagcgattgcggtatagaaatcagccattaatgtcttaaatggaatgccggttacctgcgtcaggtattcttcacaggtaagggtggaggcatctatctggtaaaattttggcaggacatccattggtttatagcttccggccatacggtcgattacataacgcataaaaagataaggcatgccgtaatcctgcgccgtatcatcacggtaggtctgatagattagggaagagccgcttcgaatagcggtacttccggcaatgccgtttaaccatccgctggaatcaatgccaccccagagatagtccatggcagtcacagccagtccctcattgagccacatatatctgccggtattggaaaatctggttttcagccagagcagtgcatgctgtccttcgtgtacaagcagaccgtttcttttggacatttcaccggaaacataggcagatgcagaaggagtgttgatatggattgctgtgatgtctgtgtcgtacatgtacatgccgcttgcggaagataaagtttcgagaagaattgaaattttaccggaattatcttcatatgggatgttaccaccggccagagtattcaggattcgataaggttgtccgtcatatacacctgccatatcctttgcgattgaggaagtcttaccagctgcatcgtaactggctttcatatctttatccatccagatatagcagtgttcaccaatgccgatgcatacataagttttgcctgtactatttgaacgatagatatatttttcctgcccgatgtagtaacttgtggcagcagactgtgcagctgctgcggaaagggcagatgaagaaagaacattataatcactggtgtcagaagcttttttgagaatctgggacgcaggcagattggctgcgctgctgccagtgctgagataagaagagacagtatctgtaccatcgtcaaaaaccagagttccggtattttgagatgaagaggtgtctgtatttataacaacggcatattctccggaaacagtctgtcctggtgagccttcaacagcatctgctgatacagaaaaacagcagaacagacctgtgaacagaaaaccgattcccatagagagaggaaaaaattttttctttttcatagggttcctccagttttatttttcggtttttattttaccatcagactggtgtaaaagctattcttttcgcagaaaatgcaatatcatgaagaaaagtaaacagaaacgtaacctgcctgtgattcaggacaataatttgttctgttggcgatattgtcttggtgacatcccgtaaatgttacggaatgctctggaaaaatgaagctggtttggatatccaacctgaacgctgatgtcaccaatggacaggctggtgctggtaagcagagaggttgctttactcattcgatagcggatcaggaagtcctgtggagactgtccgatcatatctttgaaaactttaccaaaatagcttcgatcaagattgcatcgattagccatatcttcgactgtaataggtaatgcataattttgttcaataaaagaaagtgcttcctgtgcgtaaaatctagaaagctttccgccctgaagcctttttttattggaagaaccctggataagggcatccataataagatataactgaccaatgattccaagtgggcgggaattgtccgggtattgtgtcagacgcagcatttcatcgcgaagcttatctgctgctgtatcggaaatgggatgaaagaccggatgatcgttggacagtccggcttcttccatcagctcttttgcacgcagtccatcgaactctacccagacgtattcccatgggaatttctggtcagcactgtaaagattgatacgccccggttcaatgagaaagccggaatgtgcttccatatggtaaacagcattgtcatctttttctgtaacactcagcattcctttgccggaaataatatagtgaaaaagataatgattacgtacaaatggaccataagaatgcagcggttcacatttctcgtagccgtactgatacacggtcaggtcaagaaaacgttcatcggaaaatatatgaaaaatagaatctgacatggtttttatcatttcctcctacaaaatatagtaaaatatgcataaaaacgagatacagaaatcgtacaattttaacgaaatatcgctatttagtactattatataccataatgagtagtaacatcaacattattctggaaataacgcattatggtatattttgatgttatccatctatgtacgaagcttttcttttggtgctagaatcgaatcaaacagagatgaccggtctgaatctgaactgccggatggcagtgaatagctgtaataaagaagggagaaacaaatgggaaagcacaaagtaggtgctgttttccttgcaggagttctggcaatgggaacagttatgacaggatgctccggaaaggacgaaacagagggcaaaactgtaattgaaatggtacagtacaaaccggaagcagtagatatttttgaacagtttcaggatgagttcaatgcaacgcacgatgatatttatttaaagattgattcaccgaacgatgcaatgacaatcctgaaaacaagatttatccgtgaggataatccggatatcataggaattggcggggatattaattattccaattttctggatgcagacatgctgatggatatttctgattttgaaggactgaacgatattaaagagaaatatcttgagatgaacaaagatctggaatatgtgccgaaagatggtgtttatgccgttccgtatatggcaaatgcagctggaattctttttaaccgggatatgtttgaagaacatggctgggaggttccgaccacatggacagaatttacgaatctttgtgatcagatccagtcagaagggatccagccattatattttggttttaaggatacatggactacactggcaccgtggaatgcaattgcagtaagtctgtgcgattctgatctgacttatcaggtaaacagtggaaaaacaacttttgcagaaaattacagagaagtggcagaaaaggaaaaagcgcttcttacatatggacagaaagatccggtgtctcagggatataacgatgcctgcactgcattcgcaagaggagcatctgcgatgtttacaattggaagctatgcgatctctcagatcaaatctgtaaatccggatatgaatattggttcttttgtatttccggcaaatgaagatgcggataaaaatgtgctgaattccggaaatgatctgatgttctgcgtgatgaaagattgtaaaaataaagaggcagcctatgaagtgctcagttatatgcttgaagatgaaagcattaaaaaatatctgaatgcacagagtgctgttccatgtaaaaaaggtgattttgagattactccggagctggaagaaatgcgtgattatatcgaaaacggtattgtagcggattatcaggaccatcattacccgagcgaaatgtcggtagatgcaatgatccagacatatctgatggatgacagtgctgatgcgacagatacatttatgaaacgatttgacaaagaatggatccgctataacagagatatcgtggcaaaagtaaaagcatatgaggagggcaatgatcatgaataaaaagcatggtgcgtggagcaaaaatgaaaagatatttcttggccttctggcgccgattctggttcttttcttctgctttaatacattaccgctgatcaaaggtttttattacggacttacaaacttccgcggatatggaagttatgattttgtaggactgcggaactttgcagaaattttccaggattcccgtgtgggtcactcatatctgtttacatttaaatatgcactggttatgacaattgtggtcaatctcctcagcctgatcctggcactgggactgaacagcaagatccgtggaaaaaatgcactcagaggaatctattttgtaccaaatattctgggaggtctggttgtcggttatatcttcagcttcatttttacctatattctgccgacgatcggagaagtaacaggaattggtttcctgaaaacgagtctgcttggaagcacaaaatgggcatggcttgcaatcgtgatcgtcggagcatggcagggaatcgcaatgaatacgattatctatatttccggtctgcagacagtaccggaagaagtttatgaggcatgtatgctggatggagcatccggatggaaaaaatttaagagcattacacttccattgatcatgccatttgtaacaattaaccttgtcctttgtatgaaaaatgcgctgatggtatttgaccagatcatgtctttgacaaaaggtggcccgtcacagagcacagagtccatttcttatctgatctataacaatggtatgagtggaggacagtttggtttccagagtgcgaatgcatttgtattctttattgtgatcgttgcgatatcactgtttcagatgaaattcctgggaagtaaggaggagcagttataatgagcagaacaaagaaaaaagaaggcgctgttcgtggtaagactacaaacaggattattaatattttactggcacttggctgcctgacggttttatttccactgtatatgacagtgatcattgcatttaagaagccatcggaaatgacaaatgatgtagctggtgcactggcatttccacagaaatggagttttgaaaactttgcagaggcaatgcgtgtaactgatttctggcattctcttggaaacagtcttcttattaccggggtaactgtggtattatgtatattaatacattcacttgccggttatctgatcggaagaaagatgaagcagcgtaagatatttaagatttcttactattacattgtaagtggtatgtttgtaccgtttgcggttcttatgatgccgctggtaaaagaaactgcacagctgggaatcgcaaaccgctttggtgttattgtattgtatgttgtgttttttatgccgatgaatgtactgctttattccggatatctgaataatatcccgatggcactggaagaggccgcctgtgtggatggagccggagtatggcagacttactggaagattatttttccaaatatgaaaccgatgcatgcaacagtagcagttctcacagcaatgagtacctggaatgacgttatgactccactggtcatcatgtccggtacagatcagaacacactgccgctggcacagctgaatttccagacacagttcggaacgaattataacctggcatttgcatcttatcttctggcattacttccaattttaatcttttatatcatctgccagaaacagattatcaatggtgttgtaaacggagcagtaaaataattcttaaaaaagacagaaagggaaaacgacaatggctatcaatataaagaatcagatttttactcttcatacaaaaaatagtacttatcagatgaaagtggacgagcagaatatgcttattcacacttattacggaaaccgtacggatgatacggactgttcctatctgattcgtatggcagaccgtggattcagcggaaatatcccggggactgacagagagcgtgtatattctctggattttcttccgcaggagtttccggtatatggcgacggagattatcgtgtagactgtctgaaagcagaccttggaagcggtgtacaggacgggatgtttttctttgacagctatcaggtaagagaaggaaaatataacattccggggcttccggcattcttttcttctgaaaaatcagaaggagagacactggagatcgttctgaaagatgctgttgaagaagtctatgtacatcttctttatggagtctttgaagagctggatatcattacaagagcagcagtagtcgaaaaccgtacagagggtgatatccagatttccagaattatgagtgcgtgtctggatcttggaatgggaaaatatgatctgattcatttttatggaaaacatgccggtgagcgtcagatggaaagaaacagtctgccacacggcatcacggagcttcgcagtacccgtggaacttccagtcaccagcataatccttttgtgattcttgcggataaagacactacagagagtactggtgagtgctacagtgcatcttttctgtacagtggcggttttcatgcacaggcagaagtagatcagtttaatcagacaagactggtcattggaattgatgactatgatttttcctggaaactaaaaaagggtgaaagcttcagcacacctgaggtatgtctgacatacagtgcagatggattttcaaagctgtcccagactctgcatcaggcaatcgtgtcgaatctgatccgcagctgctggaaagacagagtgcgcccgattctggtaaataactgggaagcaacctattttgattttaacaaagacaatctgattgcaattgcaaaagaagcggcagaactgaatctggatatgctggtactggatgatggatggtttggaaaaagggatgatgatttctccggtcttggcgactggtttgtaaatgagaaaaagctgtgcggaaccctttctgagctggtgaaagaagtacatgatatgggactttctttcgggctttggtttgagccggagatgatctctgaggacagtgatctgtatcgggcacatccggactgggcactggtcatatcgggaagacagccgatcagaagtcgttcccagctggtattggatatgtccagagaagatgtgacagattatctgacagagcggatctgtgatattgtagagaaagcggatatccagtatatcaaatgggatatgaaccgttcacttatggctgcttacagtgcgaagcttccacgtgaccgtcagggggaactgagacatcgttatgtgcttggcctttataaagtactggaagctgtgactcagagattcccggaacttctgctggaaggatgcagtggcggcggtggacggtttgatgcaggtatgttgtattactgtccgcagatctggtgtagcgataatacggatgcgattgaaagactgcggattcagtacggtacttcctttggctatccgatgtcttctgtttccgcacacgtatcggtttgcccgaatcatcagaatcatcgcgtaacaccattcaagacaagaggaatctgtgcaatgcagggaacatttggatatgaactggatctcagtaagatgactgatgaagaaaagaagatggcgggagaacagattgcgttcttcaaagaacatggaagactgttccagttcggagattattacagactgacttcaccatttgaaaacagagactatactgtatgggaatatgcggcacaggatggcagtgaggcctgcatgtctgtcgtttatacagatatgtatgcaaatgcagcatctgagatcgtgaaatggaaagggctggatccgaaaaaggtttatcagatgcagctggatggagaagacgctggaaacttctccggcgcggcgttgatgcatgccggaatcctgcttccattaccagagcaaaattatgatgcattccagatttatctgaaggcagaatagaataaagagaaattacagagaaagctcctatggtgtcgaaaggcattgcaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagaataaagagaaattacagagaaagctcctatggtgtcgaaaggcattgcaggggctttttttatttaggaaaccacgaaattgtgaataatatacaaaaataatttgataaaaccatacataatgcatgaaatgaaaaaagtatatttacaaagtaaaaaatgaatggtaatataaagaaaataaacaatgtgaaaccggttaacatatggagaaaagttataatacgaagggagaacaaaatgaagaaaaaggtaattgcacttgtattaacagcatgtatggtgccagttgtcagcgttggcagtggggtggatgtaatggctgccaagggagattccggagataaaattacattaaactggcagagctatgatagctatgacaaatatcagaaagttatcgaagcttttgaaaaggaaaatccggatattgaaatcaattttgaagaagtatccgattatgcaactaaaattctgacagaagctacagcaggtgaccttccggatcttatcaactgtaatacagggactacgcagattcttgcaaatgccggggcattacagaaattcgatgtagatgcgctgaaagcagatacagaatacaaatttgatgacttctgggatgccgcagaaagatattgtacatatgatggtgactggtattcactcccacttgatggaggaaattacggctgggtttataatgttgatatgtttgacaagtgcggaattgaagttccggaagatggatttacatgggatgaatttacagaggcatgtaaaacattgatggaacacaaagatgaacttggaattgaatatccgacaattatcaatgatatgtcttctgcaattgatactatgtatccatggattacagaggctggtggaagctacctgaatgatgatggaacctgtggatggaattcagatgaagccgttacggctttcgaatatgtcaagagtcttgtagatgaaggttatgtgcctgcaatagaaaaattgggagacggttatgatgcactgatcacaaaatttaatgcgggtcagattgctatgtgccgtgtggctctctggaattccacatatcttcaggacgatgtaaactggaaagcgatgaatgcaccgcgtgcgaatgatggtacacaggcagaagtacttttcctgaatggtattggtatttcaagtagttgcgaaaatccggaagcggcagaaaaattcattaaatatttgaccagcgaagaaggtcttgcattatatcttgaagataatacatctccacagattgcagtaagacagtctcaagcagatctttccgtatctatgtttgacgaaagtcatgatatgaaattatttaatacaggactggagtatgcaggatatattgatcttacagaaacatttgcagatcagcagacaatcattggacagtgttttgatgaaatctggcataatgatgcagatatcaagagtacactggatggcatggtagatcagttaaatagtttacttgctcagtaactgaaaacaaaaggatgatatggaaaatattctgtatcatcctttgaatttaacaggagggattcatgtgagtaacacaaaaacagtagtaaaacgtaaaagaggagactggcagatcgctgttttgtttctgctaccgtccctgattttgttgggattgtttgtattctggccaatgatagattccatccgtatgtcattttatgactggaatccattaaaaggtaagatatttacaggattggaaaattatcagaatctgctaaaagataaactttggtggacaagtctggggaacacgatcaaatatatcctgatgaatgttccaccgatcgtcatattttccatcatcatgtgcgaacttgtgttgtttgcaaataataaaagtaaagttatttcgaaatttatcagaggcagtttctttttaccatgtgcactttctctggttgcaactggtgttgcatggagatatctgatgggaacgaattatggtgttatcaataatttcttgagtgcattgggccttgaaaaagttggttggctgacagatggaaagattgcactgggttctatggcaatcgtaacaatctggagatgggcaggatattacatggttatggttgttgctggacgtctggaaatttcgcaggaattttttgaagcggcagatttggacggcgcaaatgcatggcacaaatttgtttatattacattgcctcagctgaaaccagttcttacatatattattctcatgtgcgtaatcggtactttccaggaatttgatcttgtttatacgatgacaaatggtggacctggaacaagtacgtatttaactggtctgacattatataagactgctttttcatctttgaaaatgggatattcctgtacaatggcagtatttatctttattctttcgattattatttcggttgtacagttgaagctgacaagtgacaaagactgagaagggagaagagactatgtccagaaaattaagaaagaaaattctgggagacagtttaatctgggtaattatagctgcatttgtagtgattatgctgtttccatttgtttatatattatctactgcattaaaatcagatacagatcttgcgacaagtgtaggaaggatcttaccgaaagcggtacagtgggagaattttacaaaagcatggcagctgctggattttcctaagtgctttttcaattcatttattgttgcgatagcagtgactgcacttactatttttctttgtagtttagctgcatatgtatttacgagacttgagttcaaaggcagaaatattgtttttattctttatttgtcaacgatgatgattccgattacagtaagattgattccttcttataatttatgtagaaatctcaacatgctggatacatatatgggaatgatacttccgcaggtagcatggtccattccgtttggaacatttcttatgcgccagttttatatgggaataccgaagcaactggatgaagcagcaaaaattgatggagcaaatcatttccagatattctggaagatcttactgccaaatacgaaatcaagtatggcaacattaggaatctatacatttatttctgcgtggaataatctgatctggatgttgttatccgtcagaagtgaaagcaaatggacagtaacattgggaataagttcaatctgtggcgcatctgtaatcaaacagccgacatggaatctgatcatgggtgttatcgtgattggaatgattcctgttctgattctgttttttgcattccagaaatattttatgcagtctgtagctgcaaccggcattaaataataaaaggagatcagttatgaaaggtttagtggtaacagaagacaataaactgtacctggaagaaaagcttccgattccggagatcggagagtatgaagcactggtaaaaaatgaatgctgtatgatctgtaacggaacggatctgggagttattggaggaaaagtcagagaagtaacgagatatccggcggttttaggacacgaagatgcaggaagagttgttaaaatcggcaaaaaagttacttcttttaaagtgggagatcttgtagtcagggcaggacaaccggataatgagaaattttccagcgcttggggcggatttgctgaatatggaattgtaaaagattataaagcagccatggcagaccaggccgatgtaaaagatattaatcttggaattacacagcaggtgtgcccggaaggaatgcaggcagaagctgcttctatgctgataactttaaaggaaacatacagtgcattaaaaagaatcggcgttgaagataaaaagaagatggtcatactcggagacggaccggttgcgcttgcttttctaagctgtgcaaaactgatgggaattcaggagatttatgtcctgggaaatcacagagacaagctggaaacagcagaaaaactgggagcagcaggtacatttcttaacaaagacgaagaagaaaagaaaaaagcttctgatctgtttgacagaaagtccgatatctgtatagatacgattggatcaaatcagacaatcacgcagtgtctggactatattaaagagacagggacaattgctgtatatggcttaaaaagcggagaaaatctgaatgtaccattaccggaactcaggaatttcaatattcagtatgtgcagtggccggtgcctgaggtagaagcagaagtacataagccagtttgtgatgcaatcatggacgggaaaatagacattgatttatttgtgacacacagattttcaatagatgattacgaaaaaggatttcaggcagtgaaagacagaactgcattgaaggtagttttaaatttttaaggcagctcaggaggaaagcatgatggcaggttatcgattcaataaagaagaatattttaaagagaccaaagctgtatattctaattatccaacagatgtttcaagaatggaaaaagaactggatcgccttcagaaagaaaatccaaaggcaagttcttttcagaaaaaaacatggatttacagaacagcagccagggatgctgaggtgattctttttccatccagtccgttttatgcagaaattgatacaggaagagagcagaacagtgttactgcatcatttccaccgcagccaggcataggatgctggttaatgaaacaatatccagatttcgtagatggatatggagaatggagtggatactacggaaaatatggtgtcatgaacggaccacagtttatggatgcggcacatcattatgcaaattgcgagactatattgaaatatggcttatccggaataatcagacatgcaaggatgcgcctggaagagaaagatcttacagatcatcagcaggattttttaaaatgcatgattgacgtatgccgcagcctgcagagaatctctgagagatttgccgaaaaagcagaggaaatgctgaaaacagaacacgatgaggaacatgtaaaggcacttaaaatgattgctgttacagcacgccgaattccatctgaaccggctgaaacattttatgaagcgatgtgtgcaatctggtttacgcgtgagatgtgcaacgcgctggatggacttggatttgctgtgattggccatttggacagaatcctgattagttattatgaaagagatttgaaaaataatcgaataacgccggatgaggcgcaggaactggttgactgttttgtatcaatgacagatgcaagatgggatcttgaagcagacctgccagggggcacaaatgcagatattattataggcggatgtgataaaaatggcaatattgtttataatgacataagcaggatgatcataaacagttataaaaaatatcattttgcaaatccgaaactacaggtgagaatatcggcaaaacatccagatgaatttctgctgcaggtaggcgagctggcaggaatggggctaaatgtgctgtccatctttaatgatgatgttataattcctgcaaatcagaagcagggaaagagtttggaagattgccggctttatgttgcaggtggctgccaggaaatctgtctttctaatgaagtcaacagcagagcatatacctatcttaatcttgtgcagatgttaaatggatccttatatccagagtactggaatgacgtatttaaaagggatggatttaaatttattccagctgcgaatgcgagcgattttgaagaattctatcatattgtaattgaaaattatagaaatgaactgaatttctttgtgaaaaaatataacgaatatggttcatggtggaaaataataaatccgtcgttgttcttttctgcaactatgccatcatgtactgagacggcaaaagatgtctcagaaggcggtgctgtctataatacagataattttgctgctgcgggtgcagggacagtaattgattcgttatatgcgataaagaaggcagtatatgaagataagattacgacatttggtcacctgcttaaagcgatgaaagaagacttcagagatgatgagatccttcgacaatatttgcttcataaagtcccaaaattctgcaaggataaagatgctacagaatttggaaaaaaggttatggatgatctggctgaatgtcttggaggacaggcaaattacagaggcggaaaatttgagccgtcattatttgctttttattcttataactggtttaaaaatgtaacgattgcaacggccgatggacgaaaaagtgaaagtgctctctcacgaggcgttaacccaagtgaaagtacagaaaacatcaatattgcagcattacttgatgcaataaaaacaatggattacacgaaatatccgggtggggcagttatttatatggacattccactgatgtataaaactccgcagccgtcattgtttgcaagtgtgatgcgggccttctgtgaaaatggcggaagcattatggattttaatgttatcagcaggaatgcacttttagaggcacagaaaaatccggaaacacataaaaatattgtagtaagagtgtgtggatacagtgcatatttccatacattgactgcggaaatgcagaatgaggtaattcagcgtacacagaggtaagcggtaaaatgaagcaaaaattactggtaagtcagatacagaacttttctctgcatgacggaccgggaatacggacaactgtatttttacagggatgtaatttgcgatgcaaatggtgtcacaacccggagacatggaaaaagaaaagtatactgagttatacggaaaataaatgtattggctgtggtcagtgtattgaaatctgtccctcaggagcacaacagatacaaaacgggcagcatatttatgaaagaactctttgtactgtgtgtggaaagtgtgtggaaatttgctgcacagaagcattggaaatcgtaggaagttattattctgttgaagaattatcggaacttttgctcagagacagaagactctatgaaatttcagaaggtggtgttactttttccggtggagaaccaatgatgcaggcagagattctatatgatttgtgcaacagacttcagaaagagcatatttcagttgcttttgaaacagcacttgcttttccttggaaagtgatacacagaatgacagaatgtgcagatctgtttcttgtagattttaagatgtttgacaatgaaaaacataaagaatatacaggaacagaaaataccctgatcaaagagaatctgaaaaaactggtgaattacagaccgatcatgatcaggcttccaattataaaaggaatcaatgatgagatagaaaatgctgttgcaacagcagatttttttgcagctcttggaagaaacatcaagagtgtggaatttttgccgtatcatgattttggagttgaaaaagcaaaacatgtcggagtgaatcagcagatgtttgaagcacctgatgaaaaacagctggagctgctgaaagaagtttacagaagtaaaaagattgacgtagtggaataaagaagattgctaacagaaaggaacagagacagaaatgaaaaagcattttctgaaaaagcacgaagaaaactggttgcgcattccttatgaagagaatgcagatccatgtattataactatttcagacagtactggaaaaaaagaaactattcagatgaaagtatctaagacaagagtggactattggatggcatatccgttgaaagaattttctggggacgatattcaggcagaaggcccggcgaacagatggatcaatgcaatagaactttctgataatccggaaaaacagagaagaagagaattgtctaagtctgtcattcagtatatgccgccaaccggatgtatccaggaactgaaaggtgtaaaaaaagcaggagaaaagtggattctggactgtgtgattgatccgtgttcgatgacaggaattgaagaaaatcaaacagctatgtgtcttgtaagcaaggatctcctacactggaaacgtgaggaaagtgagcttccggggatcgaaagtatctgtcggaaagcggataaatggattggtgatattgaacaacaaatagaatttgaagaagatggaaaaatatggattttaggtcagactgcgaaaaaaacatgtgaaggtgttgctgcatccaatgcaatcagtattccatccgttttttcaggagaacagttaaagccggctgcacaggtggataatctgcgtgtgtgggtcagacagtggcataatgagcatattgataagaagtttgaatttcttatgagatttcgtcagggaccggatgtatggccggaagtccgactcctggcacccgaaaatattgtatccgatattcagacaaaagcctgtgaagtagaactggaaatgtttgtcgggcaggaaacggaaattgagtttgagttgtgtggagtaaaatggatctggaaggcattggatcagacgctgaactgccggggatataaaatgaaagttccaacagaaaagggaaggttgtacctgcatttttacagagatatggcaattcaggaattatacgcagacaggaagaatgcaatgctcatagttcaggacgatggtcctaaaaaagaggattataagattcgaagtgagcaggtggaaaacatcaacaatccatccttttatcttcaatataatgcagaaccgtattttgaaatccatacaaatggaaaaacagcctctgtcatttgtctgaatatatggggactgagatctacgcgatacgaagaagaaaacagattgttgattaaacaggaagaaaaaggacaaccgttgtttaaatctgaatcctatacagtatatgagaactgtgtagaagatcgtatttatggagaaccggcagcatgggcagtgagggatggaaagaccgtgttatcaccggtgagggctgtagaagaattttgctggagagatactccgtggggagacatgacaagaatccagaatagaaccgagcgttgggatgcaccggaggagtctgtttatccgagtctgcacacaaagcataatgttataaatgccgcattttctcttgcaacagatattatgtgtcagaacaggaataaaaaatatgccctgccaggccaggaaggtctgatgaatgcagctgtttttcaaagagaaggagaaggtttcggaagctgggtaagagacacctgtcatgcagcatttcgatgtcagaatctacttgcaccggacgaagccagagaatctttgtcctatatttctgaacatggatttaataatggcgttgactgtgcagcaatgccggcgattgctgcatgggatcattatataacaacaggagatattcagcttttgtatgaaatgttgccgggaattataaaatatgcagaagaggcagatgcacgctatgatgaagaaatgcagctgattcatgcgacaatgtgtcttgcacaggatgcctttgaagagccggaaaatggaggatattgtcttgggacagaaattacatttgctttgatgtatcaggatgttgccaagatatgtaaggttacaggatgctatctggagagaattaagttctgggaaaatcgtgcagaagaaatgtttacatccataaaggaaaaatactggaatgaagaaaaagaatgctttacaagtggaccgataggaagcgaagcatatgaaaaaggctggtgggaaacgactggtgcagaaatggttttgtggccacggtttggcattgcaactgaaagacagagaaatttgtttttgaagacaatcgaaagtaatccggaggcattttctgagtttggaattaactggtatcctttccgtaaagaaaaaaatcatttctggagagcttgctgggtatcatggacgcttggattatcggaagcggctggtgaaagtggaaataaagaatttctgaaaaagcttatttatgcacaggtaaggaatgtgcttctgaataaatcgttccatgaagtaatggatgttgatacaggaagagcatggagatggccgcacctgccatggcatgcagcagggtttattgggtttattgtcaatggagtttttggaatacgttacagtgagcagggaattcaggtacatccatgtattctggatgaatttgagggagcagtacttgattctgttccatatcagaatgcaaaatttgtatttgagatacatgggcatggtgacagctatacagtaaaactggatggaaatccgctggaaggtttctttggcaaagaaatgacaggagagcataaagtggatatatatgctcatgaaactgaataagagtaacgtagcagaaagctcctgaatgggagctttttgcatgcaaaaaaacagagtttggcttgcgaaacatacgagtaaatagttataataataaaaagatgagttaacctgtaaaaacgcggaggattaaatggcaaatattaaagatgtggctaaactggccggagtctcggtgacaaccgtttcgagagtattaaataataaaggatatatatcacaggatacatatgaaagtgtatatagagcaattgatcaactggactatgttccgaatcagattgcacgaaatctttttaaacagaagtcttattatatcagcctgatcgtgccggacagctcgcatcctttttgggcggaaataacgaaatatattgaaaggaagctttataaacatcattataaactttttctttgtaatacgggagatacggaagataaagaaagagattatataaaaatgatgagagaaaatatggttgacggtattattcttggaacacatatgctggcagagacagaatatcagaatctggatttgcctattgtagcgttggattaccgggtggcagaagatattccgaccatctattccgatcataataaaggtggcctgctggcagcaggagaaattctaaagaatgactgcaaatgtgttttaaatgtaacagccgttgtgacagataaatctccatctattaaccgtcatagagctttttcagaaacattgaagaaaaatggtgtaaaatgcattgattatacctgggatacaaaacaaaaaacggaagattattatcagcagatgaatgaactttttgataaatatccagaaatggatgcaatgttttcagaagatctgattattatgaatgcgttaaaatgtgcaggtgagaggggaatgcatattcctgacgaatttaaaacggtgggatatgatggaactttgattgcaaagatgagttatccatcaatgacttatatttcacagccaataaaagaacttgcagatacattggtagatgtattgttaaagaaaataaacggtgcaaaattatctgaagatattgttttagaggatgtctgtctggtaaaagggcaaactacagaataaagagaaattacagagaaagctcctatggtgtcgaaaggcattgcaggggctttttttatatgaaaaatccacaaaataaagcataaaaaaggaagaacggagtcgagttcttccttttttgagatatatttaattcgattaaattgcgtccagtgcctgagcgatatctgcgatcagatcgtttttatcttcaaggccgcaggagatacggatcagtccggctggaattccggcagcagcgagctgctcgtcattcatctggcggtgtgtggaggttgccgggttgaggcagcaggttcttgcatctgctacatgtgtttcaattgctgcaagtttcagatttttcatgaatttttcggcagcagcacgtccaccctttaattcaaaggaaacaacaccgcatccaccgtttggcagatatttctttgcagtttcatagtatttgttggatggaagtgtcggatagtttacgaattctactttgtcgtgtttctcaaggaattctgcaactgcctggccgttttcaacatgtcttggcatacgtacatgaagtgattccagtccaaggttcagaataaatgcactttgtggagactgagcgcagccgaggtctctcatcagctgagaagtacatttggtgatgaaagcgccttcttttccaaatttttcagcataggtaactccgtgataagaatcatccggtgtgcagagtcccgggaatttgtctgcatgtgccatccagtcaaatttgccgccatcgatgatcgcaccgccgagcgctgctccgtgtccatccatatatttggttgtggaatgtgtaacgatatctgcgccccattcgatcggacgtaagttgaccggtgttgggaaggtgttatctacgatgagcggcacaccatgtgtgtgcgctgcttttgcaaatttctcgatatcaagaacggtaagtgccggattggcgatagattcaccgaaaacagctctggtattttctttgaaagctgcgtttaattcttcttctgtgcagtccgggtcaacgaaggtaacgtctacgcccatttttttcattgtaactgcaagaaggttgtaggttcctccatagatggaagaggaggaaacgatatggctgccggcttcgcagatattgaagacagcgaagaagtttgctgcctgtccggaagaagtcagcataccagaggtaccgccttcgagagctgtgatcttggctgcaacatagtcgttggtaggattctgtaatcttgaatagaaatatccttcagcttcaaggtcaaagagcttgcccatgtcttcgctggtatcatatttgtaagtggttgactgaatgatcggaatctgacgtggttcgccgtttcctggtgtgtagcctgcctgcacgcattttgtattaatagtatagtccatgaatttgcccacctttatataaattgtaatatctttatgttatacttttttttgttatatgtaaagaaaaaatacatacttgatcggtatgagaaggagaagaaggttattgcttattatgtaaacaataacgagagaattatgggacaaagtaacaaagcattacacgagaaatatgaattccgcaatatcagacgggatgagattgaacaggcagtgaaaattgaggcaatctgttttccgccaaatgaggcttgtacatatgagcacatggtaccacgaatcgaaaatgcaccggatctttttctggtggcagtggaccgaaaaactggaaagatggcagcttttctgaatggtctggcaacaaatcgggaacatctgacggatgacttttttacggatgctgaccagcatgatccggctggtacaaatattatgctccttggactggatgtgctgccggagcaccaacaccagggactggcaagagaactgatggaacaatataaggaaagagaacaggttaagggaagaaagaagctgatcctgacctgcctcccggataaggttgagatgtataagaaatttggctttaaagaccatggaatcggtgattctgtgtggggcggcgaagcctggcatgagatggatattgtgttggagtagagtaagatatccttctttgcagacttgaatttacattcgtttgatattataatcaaagggattgaaacgaatcctgaaacagtgggaacatttaattttaaggaggaatcttattatgattacctggaacaacctggatactcttgcatcatttaaagagctttccaatgtaaaaaaagtaaaccttgtagaagccatgaccggagaaaatggtgcagaacgtgtaaagaactacagtgtaccgatggctgctggtcttgcatataactatgctgcaaagcaggtagatgatgaagtactggaaggtcttaaaaaactggcaaaagaagcacagcttactgaaaaatacgcagctctttacaatggcgaaatgatcaatacaggtgagaaacgtcttgttcttcatcagctgacacgtggacagcttggtgatactgtcacagctgacggtgttgacaaacgtgctttctatgtagaacagcagcagaagatcgctgactttgccaataaagtacatgcaggtgagattacaaacgcagcaggagaaaaattcacaactgttgttcagatcggtatcggcggaagtgaccttggtcctcgtgcaatgtatcttgcacttgaaaactgggcaaagaaaaacgacaaattcaaaatggaagcaaaattcatcagcaacgtagatccggatgatgcggcagcagttctgaattctatcgatgttgcacattccatttttgtactggtttccaaatcaggtacaacccttgaaacactgacaaacgaatcttttgttaaagatgctctgaagaatgcaggtctggatgcttccaaacatatgatcgcagttacaagtgagacatctcctcttgcaaagagcgatgattaccttgctgcattctttatggatgattatatcggtggacgttattcttctacatctgcagttggtggtgctgtgttatctctggcattcggaccggaagtatttgcagaattccttgaaggtgcagcagaagaagataaacttgctaaaaacgaagatgttatgcagaatccggctatgctggatgctctgatcggtgtatatgaaagaaacatccttggatatccaagcacagcagttcttccgtattcacaggcactgagccgtttccctgcacatctgcagcagcttgatatggaatccaacggaaaatctgtaaaccgtttcggtgagcctgtagattatgtgacaggaccggttatcttcggagagccaggaacaaatggacagcattccttctatcagctcctgcatcagggaacagacatcgtaccgcttcagtttatcggatttaagaacaaccagatgggtacagatgtagtgatccaggacagcacaagccagcagaaactctgtgcaaacgtagcagctcagatcgttgcatttgcatgcggtaaagcagatgacaatcgcaataagaacttcgaaggcggacgtccgtccagcatcatcatcggcgagcaggtaaatccggcaagccttggcgcactccttgcacacttcgaaaataaagttatgttccagggattcctgtggaatgtaaacagctttgaccaggaaggcgttcagcttggtaaagtccttgcaaaacgtgttcttgcacacgagacagacggagcattgaaagtattcagcgaccttctgaatatctgatcttgaaattagattaattatgaaatgatataagcccttcatttacagatgagattctgcaagtgaggggcttactttatatgttgttatctccgttctacgatatgataatacgattttgcggtcataagatagatcaggccatataccagtgcaaagatcagcaccgtaccggcggtacagccgatgaacaatctggtatttgtcatgccgaacagcaggagcatccggcggatcagtggaaatgccatggaaatatgaagcattgccatgagaagcggaaggaaaaataccatcaggatctgacgtcggattgagcttttgacttcgcgatggctcagtcctactttctgcatgatctcaaaacgattctggtcttcgtatccttccgagatctgtttgtagtagatgatcatcgctgtaccgagaaggaaaagtgatccgaggaaaattccgatgaacagaagggaaccgttatctgcgtagtaggaatcatattcctgtgcacggattccggaagtaatccaggagttatccgacagctgtccattatcttgcagagcttttattgcatccagtaccggtgtaccataggcaatttttgtttcatcggagccggtgatatccagaccaagatgaacggtcagatcctgtccagcaggggtagctgaggtattcttatacatttctgttcgcattttatcaaacttttcaaaatcagaatcagtgacaacaaatactgcatttctatagacgatatcgcgaccacaggtcagaggagaattctccagccattttttcacagagaaaacagaatcattgactgtgagagaatctgatttttcagtcatctttgaagcccatgcaagaatctctccatcctgtaatgccggatttgtaccggtaagtttcttatattcggattgacgaagaagagaaagagtcagtacagaaccagactccgttaaagtacctggctcagcaatctgaatctgcccgtgatctatacgactgatgattgtgagataaatttcttcggcttttttgtctacaggaaccttgttgtcagaaattgctttttcaaatgtttctattgcagtctggcattccttttcactgacaccggtaatggagatatcggtatcgtatgagtaacggtttaccatgatatcattcataccaaaatagatagagacagtcatggaaatcatgagcaaaactccggtacttaagatacagatactggccagcccgacagcgttctgcttcatacggtaaagcataccggaaatactgataaaatttccagtcttgtagtaaaagctttttctgcggcgaagaaacttcagaattacaatactgcctgcagtaaaaagcagataggttcctgccataacaaggattacggcaagcaggaagattgtgattgctttaattggtgattctgttgtgatggcaaggtaataaccgataccaagacagataaaaccaagcagtgccataagccattttgctttcggctctctttctcccgtgttgctgccacgaagtaattctaccggacggcttaaatgaatccttctgagattcagaagaaggatcaacaggaaaatggcaccgaacatcagaagacaagtaataattccctttgtggaaatataaaatccaagtactgccggaatatgcagcagtctcagaagaaggagaagtgacagtttactggcaaggattccgattgcgattccaccagtgagggaaaggatcgttgtaaaaatcgtttccagtaacagtacaatgccgatatgatttctttccagtccaagaatattgtaaagtccgatttctttctgccttcttttcatcaggaaactgttactgtagatcagaaagatcacacagaagatcacaacaacaacttctcctgtagagagaatcattcgtacttctgcggcatggcgaacagcctgatccagcgttggacagtcgcgtaaaaattccatcatatagatcatggcgatgcagaagatacaggtgatcatgtaaggaatgtaggtgcttttattgttgcggatgttctgaactgccagttttgagaagattcctttacgcatgatattcaccgcctgttgtcagtatggtaagcgtatcggcaatcatctgatacatttcctggcgggatttactgcccttataaatctgatgaaaaacttctccatctttaataaaaaggactctggatgcatggctggcagcctgtgcactgtgcgtgaccatcagaatcgtctgtccttcgtcattgatctcgccaaacatggaaagcagtgcagatgctgcttttgaatcgagggctcctgtgggctcatcagcaagaatcagcttcgggtctgtgatcagagctctggcaaccgctgcacgctgtttctgtccaccggaaacttcataaggatatttatccagaagttctgtgatacacagtgcctgtgcaatcgggcgaatcttctgttccatttctcggtaatcttcgccggcaaggacgagtggaagataaatattatctcttaaagagaaggtatccagcagattaaaatcctgaaaaacaaagccaaggttttttcttcggaaagccgagatttctttttctgtaagatgtacgatattttttccttcgaggagaacttctccggaagtcgggcgggagagagatgccagtatattgaggagggtagtctttccggaatcggattctcccatgattgcaacaaattcccctttttctatagaaaaagtgacattggagagtgcctgcactttgtttcctccgaaacgggtgctgtatatttttttgatattagttacttctagtaaagccataaccggggctcctttcttttttattgataaggtaagtatagaaatctttcccggcttctgccatcgaagcaggttacaatatacgaaaaaaccttacatttctgtaaggtcgtttcgaatggaggcataaactcctaggatatttctaattaatacatggtcaggacattctgggaaaattccaggaatacttttgttcctttgccttcttcggaagttacatagatgcgatgaccgagacgtttcatgattttcttgctgagatacagaccgataccggttgcacggttgttttcacgcccgttgactccggtgtagcctttttcgaagatacgtggaagatcttccttgcggataccgatgccggtatcttcgattataagtgtaacgggagatgggcttatcatgtttgaaatatcctctgtattttgtgagttaccggggacatctttcaaagaaatacgaatcccgccggtacgggtgtatttgagtgcgtttgacaaaatttgtccaattacaaaaccaagccatttttcatcggtcaggacattctctgaaattccttcataagtcagagacagtttttttgaaataaagattccggcatatttatgtatctgttcgcggatgatcgaatcaagggcacagcgtgaaagtttcagatctgaggacatatcttctgtgcgcagataacccagaaccatttctacatactgttcaatcttaaaaagttcagtgagagcttctttattcactgtcggattttcctgaaggagcagacgcagagcaaaaattggtgtcttgatctggtgtgcccacatcgtgtaataatcagtcatttcttccagtgtcttctggttagcagtttcagcatctattcgcattcggttcaggctgtgcatgatctcctgctgaagagcatcggcttcgttggaaggagcatccatacgggacagattaatatccggtgctgcagagataatctgaagattatgaatgttcttctggtagttatgaaagccgaaagcacacgtaccaagcccggtcagaatccagaggaccgcaatgtacagaatgggttccagtggaagttggtacagaaggaagatcattcctgtaagtatcgtcggaaaaagcatcagtaagatttgtagttttattttgttcagataatccagaaataatttcataaagtaatccttcatagggtgagtgcttttaagttgcacattataccatgtatccaagtccttttttggtgatgataaagtctttcagcccttccccttccagttttttgcgcagacgggtgatatttacggtcagggtattgtcgtcaacaaagctgtcactttcccagagctttgtcataatggcatctctggagactgcttttccggcatgttccagaagtatctccagaatgcggagttcgtttttcgtaaggtcaatatcatgaccgttccaggtcagggtacagcgggaaggattcaggacagcacccttatgttcaaggacacttcccggagttccgaaggaataggtacggcgcaggattgcctgaatcttggcagtcagcacatccagatcaaatggttttgcaataaaatcgtctgcaccacggctcattgccatgaccatattcatattgtcagatgcagaggaaataaagatgatcggtacctgggaaatccgacgaatctcctcacaccagtgaaaaccgttataaaaaggcagtttcagatccagcaggacaagctgcggatctctgtgagcaaattcctgtatgatattggaaaaatcttctgcgcaggagacatcatatccccaggaacagagattctttttcagaaggttggcgatgatctcatcatcttctacgatgaaaatacggtacatgggcagtcctttctggtaaaattgtattttatgctaatcataacatgtctttgaaagattgcaacaaaattcactttgtggcattatagtagaaggaaattatttgatgtgtataatagaagactatgaataacaacagaagggagagtttaatatggatctggtgaaagaggcaattttcctgggattttcgggagctgccgttatggatacaaaagagcttgtttttgtgccggaataccgaacgttctgtgaagaaaacttatgtggatgttataatgtaaatccggcctgtcctccggagagcggaacagcagaagagatgaaacaacgtgcactacagtatgaaaagacgctggtgctgcagaccatgcaggaagacatgcatgattctgcacaatacaagaaggacaagttactgcagaacaaaatgactgaagaacttgcagagaagatgaaagcagagggcaaaacagatatcctgatcatgagtgccggaccgtacaaacataattcctgtatgtctgcatattgcgtggatgcacagaagatggcagatgcagcagggatgctctgctggacagacgatggaatggtacggtatttttcacagattctgtttcatgaataaaagaattttcgaaaaaatttcacaggtaatattttaccgtaaatcaaattgtattacgaatgcggatgtggtaaaatcagtatcagaaaatttgattttataaatccaggtggaaaacctggcgcatacacatatgacaggaggcttcttattatggaaagacatgcatttgcaatgaaagtaaaagcaggcagaatgaatgactaccgcaagaaactcggagagatctggccggagctgaccgctcttcttgaccgcaataaagtaaagaatttcagtatctggaatgcagaagacctgatctttggttattatgaaaatgaagacggagcgaaattaagcgaagaagaagttgcagcaaaagatgcaatcactgcgaagatcgatgacacatttgactggatttccacaccgggtgaagatatgagactgatgtatcataactttggtattgtaagagaaaataaagaattgatccgtcacagaatgtttatgacaaaactgaaagcaggatgtgaagaggaatacaagagacgccatgacggactgatcgcacagagaggtgacactgtagatccgggtccggacagtaatttcagcatctggtgtgccggtggctatatttttggatacgatgagatcgatactacaatggaagtagaagaaacggttgaatccagagagcagaccgttgaatgggaaatgcgtcagctgggaatcatggactggatcaccaatgatgtagactggatgacaggtgatgtacatgcagatgtaaaacgtctggcatggcataattaagattacataaaaagaaccttgcagcttcggacagagatgagtttaaaatttctgtaagaatccgcagggttcttttctgttataattattttttcatattcagataaccctgtatggtattttcaatcagatgataagtcagtcgcgccacctgttcaggagactcactctgtggcgaagacagccaggtacggatcagtccaacacatccgttaagaataaaggcatatggatatttgatatccggatcattttttggaaatctgtcaggaagttgtttcagaaaagtttctgccagaaggttttcaatctgttctacaaatgccatgtcaccgtgcggtccgagaagtgccaggcagaggtccctgtcattatccatgatggagaagaactggacaataaatggaagtacggaatccgggttacctgggtcaatcaggtggttctgcataacttccgtaatattctgcattgcttcttcttcaattttgtgcagcatctgataaatgtctgtatagtgcagataaaaggtagaacggttgatatcgacctcatctaccagttcttttacggaaatttccttgatactcttctgttgcataagccgggcaagtccctcccggagctgcgctttcgttttgcggacgcgtcggtccattttttctgccatgtaaaaatcccccaatctttttaccaaaaacaaacaggttttatgtaaaatgtcaaattttgacacctaatagacaaatatacaaaaaacgtctattaatatacaaaatataaaatgtttgtcggttgtaactgtttcctgtgtttagtataatacggattgcaaagaaaagcaacatgatgttgattaatagagctaaagacttttactagaaagaaaggggcacaattatgatcaaaaatgagtggaaaagcttatggaataataagattctgatcattgtcgtgatggcgatcattgttattccggtgatctatgcgggactgttcctgaaatccatgtgggacccatatggaaatctcgataaacttccggtagcagtagtcaacaatgacaaatcagtagaatataatggaaagacgttaagcgtcggttcagatatggtggatgaactgaaagacaacgattcactggatttccattttgtagacagcgacgaggcagaacagggactgaaaaatggaacctattatatggtaattacgattccggaagatttttcttctgatgcttctacactgatggatgacaatccgaagaaaatggaactgaaatatgaaacaaacccgggaacaaactacattgcttccaaaatgagcgaaactgctctgtcaaagattcgtgaggcggttgcttccaaagtaacagaaacatacacacagacagtgttcgatcagataggcacagtcggagacggcatgcaggaagctgccgatggatcaacagagcttaaagatggtctgacaacagcctctgatggaaataaaaccattacaaccaatctgaaaaaacttgcagacagcacgctgactttcaaaagcggtgctgagactctgacagaaggtttgaaagaatatacagatggtgtatcgcaggttgacagtggtgcagcacagcttgatgaaggtgttggtacactgactgacaaagtgccgacactgacaaatggtgtgaatacattaaatgatggtgtgaaaagttatacagacggagtggcaacattaaatgctaattccgcacagatcacatccggtgtgaacagtctggcaacaggtgcacagagtctggagacaggtctggatacattaaaaagtggtactactcagtatgtcagcggagcaaatacactggtggatggtgtgacacagtatgttgcaggtgcagaacagcttgcagcaggtgcgaaacagttatctgcactggaaaatctggatcaggtttctacaggaatctcacagttgaatgcagcagtttctgacggaaacagttctcttacaagtggaacacagcagctggaaagtggacttggacagctgtcatcgcagttaaagacattggcaggaagtacaaccgcagagagtatcaaacagctcgcatccgggttaaacacagctaaaacgggtatggaatctgccagtgcaggaatgagcagtgcggcagatggtatgaatcaggcagcatccgggatgaatacggcagccgagacaatcagcgcagccagtgcaggtatctcccaggcagcatccggtatgcagagtgcaacgcagccagttgctgcagcagctaacagcatgacaggcatcgtccagcagtgtgcacaggatgccaataaccagatcagtgcagcgaacgcacaggtacaggcagctaataatcagacagcagccgcgaatgcgacgattgcaaatgctgcagcagcattaagtacactgcagggtcaggctgatgagaatggaatgatttccgcagaaagtctcagtgcggtgatcggctctcttactcaggcagatgcaggagtcgcaggcgttgatggaatcagtgcagacagttatacaggtcaggcacaggcggttgtcagtgcagtttctggccagctggcatctgcacaggcatcattgaatgatacagcttcacagttaaatcaggcagcagccggactgaacagtggagcagagacattaaaaacaaaatcttctgatatgagcaatggtgcttctcagatgagtgccggagcaaaacagatggaagcaggagtttcttcgattccggaagtaccttctgatccgatcaatacggtaactgcagcagtaaatcagctttatgcaggtgcacagaaagtgaatgcaggcacaggaagcgtttcttctgcattggatacactggaagcaggaacaaaagatttcccgaaggcagcagccggtgtaaaagcactgaacacaggttttgaaactctgacagcaaatgatgaaactctgacaacaggagctgcaagtctgaaagcagccggaagcagtgtgacatccggtatcagccagctgagtgtcggtggaaagacacttgcatctggtgtgacaactctcagcaatggactgaaaacatatacagatggtgtagctactcttgccggcaataacaaagcattgacaagtggaacacagcagcttgcagatggagcaaagacacttgcagatggagccgaccagcttgcatccggtacacagacacttcatgcaggaacacagaaactggtttccaataacagtaagcttaacagtggtgctgaccagcttgcagacggagccggacagattcaggatggttcctccaagctttatgacggttccaaagaactgggcgatggtatcacaaaactggaagatggttctgatacacttgcaaccagtctgaatgacggtgcaaaagaagtaaaagaaacaaatgcatctgatgatacgatcagcatgtttgcaacaccgatcacagatgaagaaacaaagatcacaacagtagaaaacaacggtcacgcgatggcaccttatatgatgtctgtaggtctctgggtaggatgcctggcattctgcctgatgtatccgcttacagagtataaaggaaaactgaaatccggatttgcatggtgggcaagtaaagcttctgtactttatccggtagcaatccttcagggcgtacttctgattcttctgcttcatgtatttgatggatttactccggtagaaatgacgaagacaatcctgtttgcagcactgactggtgcatgctttacatctattatgtacttcttcaacattacatttggtaaggtaggaagtttcctgatgctgatcttcatggttgttcagcttgcaggatctgccggaacttatccggttgagatctcaccgtcctttgtggcgaagattcactattatctgccgtttacttatacagtaaatgcattccgcagcacgatatgcggaggagagagcatccgtcaggctgtgatcgttctgatcggactgacgatcattttctcaatattaacaatccttcagttcaaccatatggcaagaagaaagaaacagggcaaactggttcttctcgactggctggaagaaaaaggggttgcataaaggcagtcttatatgcataatagaagagtgttctgattatatagagtcacatctgtaaaagcggatgtggctctttttggataatgttgcttttggcggaagatgaagtttccagaattaacaatttcatcacatttttcccacaaagtaaacacaaatcatccttatactcttaagcataaaaggaaaacagaaacagagatagctattcacgggaaatgatttatgaagtgaacagtaatgatcctaaggaggggattttgatgagcgataaaaacaacaacgtaatgatgaacaatgatatgaataacaatatgaacaacgacaacgatccgaaagaaagaatgagaaaaaaagtaaagaaagcagcaggtattgctctttgtgcagtacttgccggcggacttgcagcaggctcctttgaaggaatcaatacactgaccggatggaacagtagcacagtagaagctgcatccaataaagaaaatacaacatttcttcagacaaaatcaaagaagaagagttccgataagaaatcagatgacaaagagaaaagcaaagatgactctgaatcaaagacaaaaggaagtctggatgtctctgatatcgcagcagaaggaatgaaatctgttgtatctattacaacaaaatctgttcaggatgtacagaactatcttggatattatggatttggcggaagccagggatatacaacacagcaggaagttgaaggaagcggttccggtatcattgtcggaaagaatgatgacaatcttctgatcgctaccaactatcatgtagtaagtggtgcagataccgtatctgttacctgcattgatggggaaacctatgcagcaaccgttaatggatatgatgaagataaagaccttgcagttgtttccgtaccgctctctgatatttctgatgacacgatggatcagatcgaggtagctacgatcggaagttctgatgatctgaaagtcggtgaacaggttgttgcaattggtaatgcacttggttacggacagtccgtaacaaccggtattgtcagtgcaaagaaccgtaaaatgaacgatcagggcattgagcaggatgaagattctgatgcaacaaatctgattcagacagatgcagcaattaaccctggtaacagtggcggtgctcttctgaatatggatggagaagtggttggtatcaactctgcaaaacttgcttccacagaagttgaaggtatgggttatgcgattgcaatttcagatgtaacagatactctggagcagctgatgaatgaaacacctagagataaagtagataaccatggtgtacttggtatcacaggtatgtctgtaagtgatgaagcttcccagtattatggagttccggaaggtgttcttgtatctgaagtaacagatggcggagcagcagacaaagctggaatcaaagagaaatctatcatcacagaatttgatggtaagagagttcgcagtactgatgaactggtaagccgtcttgagtactatgaaccaggtgaagaagtagaggtaactctggaagttgcagatggtgattcttataaagagaagaaagttacagtaacactcggtgagaatccggatgcagattccaacgattcaaaggatacatcatctaaagatgatgcgcaggctgaggattctcaggacgattcacaggatcaggaagaccagagtacggacagccttctgcaggattttgagaatcagcaggcggatggaactgcttacgaacagttctttggattccttaattaactgtcattaaaagaggtttcttgcgggaaaatttgtttccgtaaaaatataatattataagcaggaaagaccggtgcagagaattgtaccggtctttttctgcttgtgttgaaagaaaagagtctgtctgttatactagacaacagagtaaatccaaagtaactgtttaaataaaaagaaggaaatactgtatgaattatattgtttttgacctggagtggaatcagagtcccggtggaaaaaaatattccaacagtcgtctgccttttgagatcattgagatcggtgctgtgaaaatgaatgagcagagggaagttgtggatgtttttcagagacttgtgaagccacaggtatataactggattcatgacagcatacatgaagtgatccatgtggattataaggatcttgctgatggagtacctttccagcaggcggtcagagaatttctgaagtggtgcggagaggaatatgttttctgtacctggggaaatcaggatgttatggaactacagcgaaatatgaagtattatggaatgctttcgctgcttccaggaccggtcacatattatgatgtgcagaaaatatacggaatctgtcatgaagaggccggcggacgaaggagcctggaatttgccattgaccagatgggaatcccgaaggcgcaggattttcacagggcattaacggatgcccggtataccggggatatttttaaaacactggaacctgcagcagtctgtgtgaattcatctattgatgtttatcagaatccaaagaataaaaaagaagagatttttatttcatatcccacgtatgatcagtatgtgtcacgtgagtttgcagacaaagaaaaggtaatgaaagaccgggaggttgcaagtacccgctgtccggtatgtcatatgccggccaagcgtaggatccgctggtttatgaataattctcgtgcatatgagagtgtatcactttgtcagaagcatggatatatcaaaggaaaggtgcgaatccgccatacggacgaggatgcatattatgcaatcaagaagttaaagaggatagaagaaaaagatgcggaagaaatccgtgaaaaaagggattccctccgcaagaagagacaggcgaaacgtcagtcagagaagctggtctgaaaggagtctggtctggtaatatctggcagagccgactacatgatcgttatacgtatacgtaacggtcagaagtgggagacctgccggattttttgttatagagcaagttttttccagagcattggtatcaactccggatgggagagatacgctggcggtacgtcttgtttcaaagagcgtatcgtctttataatcttttaaaatgtatttttcagccggaagaagatgtcttgttatttttgatggaagatcttttaccgcagttctggaaaaattattaaaaccataatccagaagagcctttgtatcggagtaagcaccgttcacagactgcaggacgaccgaaaccagataagtattgtcattctttgcataggtaacaagcgtatttccggcagcttcggtgtaaccggtctttcctcctaagacaccgttatatgcatatgcctgattcttcatcatcttatgatggttcagaagataacgtgtctctgcaaacttgttagtcggaggaatttcataatactgcgtggatgcaaatttgcggaaggttgggttaaaccatgcggcacgcgcgattttggccatatcggaagctgtcgtataatggatttcatccggaagtccgttcgggttgttaaaatgagtgttggtgcagccaagctggcgtgccttaaggttcatctgttctacgaatttcttggtggatccggtggtaagttccgcaactgccagtgtcatttcattggcggactgaagcatgatagccattaatgcctgttcaatggtgaattcttctccggtgtctgcataaatactggaactgttagaatcagagattccataagccgcggactgtgacatggtaaatttctggcttggatccaggttttcacatccaagaagcgcggtcatgatctttgtaatgctggctggatactgtgccttatctgcattttttgagtaaagaactgctccggtaaacatatcgacaaggatagcggattctccttcaatctgagggccttttgtccagtccttgatggaatctgtgtctgccggctgcttataatatggagtgtgcggatctggtgtaggagttgccgtcaccagaggagcaccgtattcgtctgtggcgaagaccgggactgcctgtgtgatgataaccgcagagcagagaacaccggtcagaatctgccgcagaaaatgtttctttatattcatgtgtgtacctttctaatattaaaatcctgaagcaggtgcagaaagatattaagtaatgttggttgattttatataatgcatgagaaatctggtatctgggtcaattcgagaattcagaagtaccaggagtatattcctttgctaaaagcgtatgaaaaaaagccaaactcgctacgctcagacagtgtctttttttcatacaacgcaaagatttatactcaggtacttctacaaattctctcaggcgacccagaaccagatattctcagcctcatctacattcaacaacattcacagtaaaaaaacttccctgcaccaaaggctttatattgttaatattgatcaatcattcggcggggcgggaagggttcgaactgttcacgtgctcacgtacgccccgcggcccagccgtcgccgaccatgaagaaaatgatggcgatttgagtatagagaaatcatactagtattttggtggttcagtaactgactttcatgcatcatattaggaacaccagcgaggctttcggaattttggctgtgctagcgatggctgcgttgcactgtttgagcgaagcgagtttgcaaaagcagtcatcaataggcgcacagccaaaaaacggaaacgtaagctccgtgttctaaaatatgatgcatgaatgtcagttacgtgaaagtaaatacattcgatatggtttctctatacttaaatagcatatcattttctccactataccattatcatataattatactgtaatcattttctgcatacaagggttaaatccatgcaaaatccttataaaaccccgtgattctcataaaaagaccttgacatatggaaaaatataaccttataataaaacagcacaaatagatataagtaaaaactttgatggagacagtaaatcggaaccaaatctgcagagagccgggagaaggtggaagcctggtgagagtaatttcgatggaagatcactccggagtttctttcctgaaatcttaagtaaggagagacggtgtttccgccgttaaagggaacatgtatcggcatatatgattatactaccggcccgtacaatgtaacaggtggtgcgaatgtggaaattgctttcgtccttttacaggacggaagttttttttatttcatttgactattgatgaaaatttttctgaagaatttaaaggaggaatctgttgtgtatcagaaagtagatacgaacctgaatttcgtagatcgtgaaaaacaggtagaaaaattctggaaagaaaaccatatcttcgaaaaaagtatggaggaccgtaaagacgatcctacttatatgttctatgatggaccgccgacagcaaacggcaaaccgcatatcggtcatgtactgacccgtgttatcaaagatatgatcccgagataccgtactatgaaaggctacatggtacctcgtaaagcaggatgggatacccacggacttccggtagaactggaagtagagaagaagcttggtctggacggtaaagaacagattgaggaatatggtatggagccattcatccagcagtgtaaagagagtgtctggaaatacaaaggaatgtgggaagacttttcctcaaccgttggtttctgggctgatatggagaacccatacgttacttaccatgatgactatattgagtctgaatggtgggctctgaaagaaatctggaataaaaaacttctttacaaaggattcaagatcgttccttactgcccgcgttgtggtactccgctttctgcacaggaagtttcccagggatataaaacagttaaagaacgttccgcaatcgttcgttttaaagttgtcggagaagatgcatacttcctggcatggaccacaacaccgtggacactgccatccaacgttgcactctgcgtaaacccgacagaagtttactgcaaggtaaaagcagcagacggctatacttattatatggcagaagctctgcttgacaaagttctcggaaaacttggttccgaagagacaccggcatacgaagttcttgagaaatatgtcggaaaagatctggaatacaaagaatatgagccactcttcgcatgcgcaggagaagcggcagcaaaacagaaaaagaaagctcattttgttacagcagacaattatgtaactatgagcgatggtaccggtattgttcatatcgcacctgcattcggtgaagacgacagccgtgtaggacgcgattatgaccttccgttcgtacagtttgtagacggtaaaggtgatatgacagcagaaactccatatgcgggcgtttttgtcaagaaagcagatccgcttgtacttcaggatctggataaagaaggaaaacttttcgatgctccgaaattcgagcatgattatccgcactgctggagatgtgatacaccactgatctactatgcacgtgaatcctggtttatcaagatgacagcagttaaagatgacctgatccgcaacaacaatacaattaactggattccggagagcattggtaaaggacgtttcggtgactggctggaaaacgttcaggactggggtatttccagaaaccgttactggggaacaccactgaatatctggcagtgtgaatgtggacatatgcattccatcggaagccgtcaggaactgttcgagatgagcggtgacgaaaaagccaagacagtagaacttcatcgtccatacatcgatgagatcacactgaaatgcccggaatgcggtggaaccatgcatcgtgtaccggaggttattgactgttggtttgactcaggagcaatgccttttgcacagcatcactatccatttgaaaataaagaactttttgaaaaacagttcccggcagactttatctctgaggctgttgaccagacgagaggatggttctactccctgcttgctgagtccacaatcctgttcaaccaggctccatataagaacgttatcgttctcggacatgtacaggatgaaaatggccagaagatgagtaagtccaaaggaaatgcagttgatccgttcgatgcacttgaaaaatatggtgcagacgcgatccgctggtacttctacatcaacagtgctccatggctgccgaaccgcttccacggcaaagctgttcaggaaggacagcgtaagttcatgggtactctgtggaatacctacgcattctttgttctttatgcaaatattgacaattttgacccgacaaaatatactttagattatgacaatcttcctgttatggacaaatggctgttaagcaagctgaattctgtagtgaagactgtcgatgactgccttgcaaactacaagattccggaaagtgcaagagctcttcaggagtttgtagatgagatgagtaactggtatgtaagaagaagccgtgaacgtttctgggctaagggcatggagcaggataagatcaatgcttacatgactctgtatactgctctggtaacaatttccaaagcagcagctccgatgattccgttcatgacagaagaaatctatcagaaccttgtaagaagcgttgataaagacgcgattgagagtattcatctttgtgacttcccgaaagtcgaagaagcatggatcaataaagagctggaagacgatatggaagaactcctcaagattgttgttcttggacgtgcagcaagaaatactgcaaatatcaagaaccgtcagccgattggtacaatgtatatcaaagctgacaaagaaatgggtcagttctatacagatatcattgcagatgagctgaatgtcaaagaagtgaagttcgcaaatgatgtcgaatccttcatttcctacagctttaaaccgcagcttcgtacagtaggaccgaaatacggtaaacttctgaacggtatccgtacagcacttgctgagatcaacggaacagaagcgatgaacgagctgagatccacaggtcttctgacactggatattaacggaaacaaggtagaactttctgaggaagacttattgatcgagaccgcacagacagaaggttatgtaacagaagcagacggtgatatttctgtagttcttgatacaaatctgacaccagagctgattgaagaaggattcgtccgtgagatcgtcagcaaagtacagacaatgagaaaagaagctggatttgaagttatggataagattcatatctatgcaaaagacaatgacaagattcttgagctcatgaagaaccacaaagaagaaatcatgtctgaagtactggcagaggatatgactctgggcacaaccgatggctatgtaaaagaatggaacattaacaaagagccagttgttcttggtgttgcaaaaatgtaagaagttcatgcccggtaaatataccgggcatgatttgcaaaaatttggggaataaaaaagcgcagcattgctgtgtgattaaggaggaaacgcaatgattgacaagcagtttaaaaaagaagctttcaaagagagcgtaaaggaaaacgttaaatttctttatcgtaaaaaactcgaagaagctacacaggaacagattttccaggctgtatgctacactgtaaaagatgttatcattgataactggctggaaacacagaatgcatataaagagcaggatcctaagacagtttactatatgtccatggagttcctcatgggacgtgctcttggaaataacctgatcaacctgacagcatacaaagaggtaaaagaagctctggatgaacttggtctggatcttaacgtgatcgaagatcaggaaccggatccggcacttggaaatggtggtcttggacgtctggctgcatgcttcctggattctcttgcaacactgaattacagtgcatatggatgtggtatccgttatcgttatggaatgttcaaacagcagatcaaagacggatatcaggtagaagttccagataactggctgaaagatggatatccatttgaacttcgtcgtccggaatacgcaaaagaagttcatttcggcggatatgtagatgttgaatatgatccggcaacaggatccaacaaattcgtacacaagggatatcaggcagtaaaagcggttccgtttgatatgccgattgtaggatataataacaagattgtaaacaccttaagaatctgggatgcagagccaatcgtagacttcgagcttgactctttcgataaaggtgattacaaaaaggcagttgagcaggaaaaccttgcccgcaatatcgtagaagttctttatccgaacgacaaccatatggctggtaaagagctgcgtctgaaacagcagtatttctttgtgtctgcaagtcttcaggctgctattgataaatacaaaaagaaccacaaagatatcatgaaactgcacgaaaaagttactttccagatgaacgatactcatccgacagtagcagtagcagaacttatgcgtatccttatggacgaagaaggacttggatgggatgatgcatggtctgtaacaactaaatgtgttgcttacacaaaccatacaatcatggcagaggctcttgagaaatggccggttgagctgttctccagactgcttccacgtgtataccagatcatcgaagagatcaaccgtcgtttcatccttgatatccaggctaaatatccaggaaactatgacaagatcaagaagatggcgatcctctatgatggacaggtaaaaatggctcatcttgcaatcgttgcaggttactctgtaaacggtgttgcaaaacttcatacagaaatccttaagaaacaggaactgaaagatttctatgaaatgatgccggagaaattcaacaataagacaaacggtatcacacagagacgtttcctgcttcacggaaaccagcttcttgcagactgggtaacagatcatatcggaccggaatggatcacagatctgtctcagatcagcaaactgaaagtttatgttgatgatgaaaaagcacagcaggaattcatgaacatcaaataccagaacaaagttcgtctggcaaaatatatcctggagcacaacggagtagaggtaaatccacgttctatcttcgatgtacaggttaagagacttcatgagtacaaacgtcagcttctgaacatcctgcatgtaatctatctgtatgaccagattaagaaacatccggaaatggatttttatccaagaacattcatcttcggtgcaaaagcatctgcaggttatgcacgtgctaagaaaatcattaaactgatcaactctgtagcagatgttgtaaacaatgatgcatctatcgaaggcaagctgaaagttgtattcatcgagaactatcgtgtatccaacgctgagatgatctttgcagcagcagatgtatctgagcagatctctacagcaagtaaagaagcttccggtacaggtaacatgaagttcatgctgaacggtgcaccgacacttggaaccatggatggtgctaacgttgagatcgttgatgaagttggcaaagaaaacgcatttatctttggtctgagcgcagacgaagtaatcaactatgaaaacaacggtggatatgatccgagagtcatctacaatacagatgatgagattcgtcaggtgctgacagagcttgtcaatggaacgttctcctctgatacagaactgttccgtgacctgtacaattctcttcttaaccagaatggtggagaaagagcagaccagtactttatccttgctgacttccgttcttatgcagcagcacagaagaaagtggaagaagcctacaaagatgaaaaaggctgggctcgtatggctatgctgaacacagcatgcgctggtaagttcacatctgacagaactatccaggaatatgtggatgatatctggcatctggacaaggtttttgttaaataaaacttttataaaaatggatttttaagatttacgcaaaggggacttgacggtcccctttgtgcatccctggctttttagaaaaaattctacatggtataagacggaagagagttgtaattgtgtctgactcctggtgcatcatggatatattttgcgagatgtgtgcgaatgttttccattttctgttttgtatcaggattgctgtatggaatccggtcgatgatcttattcagataatcatgttcttcaatgatatcaaaacttgcacggaaatagatatcacagaaataagcaacataggatacccagtaatccattttggttacacggtccggggaataaatgcactgatctttgagtacagtgtcataaacgacaggagtgatctcctgtgcaccaatttctttgcctgaagcacccataaaaacaagaagatcatcttgcagttttacgcggcagttatcaagtttgtctgcatcacggatcagacgtgcatggagcagcgtccgattatcggtaattccttcgaggtggaaatcactgtgtctggcaattgcggtgcgaataatatcatcccaggtgtcttccggaacaaactgtcggatcattccttcttcaaataatacctgaactccataagcggcatggtccattgttgttggctcgaaactgtcaaagcgttttaactgttcaaaacgtccgatgtcatgaagcagggcaatgatgcgtgcaagttcagtatcttcttctgtcaggtgcatccgatgacagatttcactcatatcatgtacgactccataagtatgtatgatcttcagtcgaactttgtcattgctgcggtcataactttcaagataagtttcaaatttttgttttgcatcgttatagttcatgtgaggtggtctcctttaaattttttcggtattctcttggactgcatcctttaatcttgctgaatactttggaataataattggaatcggaaaagccggttttttcagcaatactgctgatggattctttggtattgagatattccaggcttcgctcgatccggtattcctgcagaaaagaaaaaagggtagtattcatatggcgtttaaaaagacgggtacattcactctcgcacaaatgaatatgttcggaaatatcatccagtgtaatctgattcatataattttgttcgatgtaggagagaatcctgcggattcgttcgtattctgtgaaatcagaagtagttgatacaggctgatgcggaaggtgttccacaagcagccgccacaggagctgcatccgaatggaaatatccagttcatagaaatccggcttttttttatcgagtgagatgacttccagcattcggtcacgaaaagtttcgtgccatttttcactgtaatcaatatgtaacgcacatacagcaagattctgaatcacaggatctacatatctggtacagatggtactttgaaagaaaccatagatcagtttgggatcaaaggtgatcggtatgtaagaacagtcctcttgattttccatttctccggaatggagggcattggaattgcagaagataatatcgccctctttcagatggaaggagcggttgtttatacgataatgcatggagccttcttttacataagtaatctcgatttccggatggcagtgccacataaaagaattggaatcgtattcagacagacactgataactgaccagaaagggaaagtgatcgcttccatgtttttttagttctttttgaaattgatttgtgataatttgcatgttaagctccttacagctgggtatcgcgcagatatgatcagatatatcagattgtatgcggagatactttaaacgcataaaattacggttattcttctcctattataggcatatttttatgagatacgcaagattttacttgtttttcgcagattaattaaggtattttacagaaaaagcagtataatgagagtatcagatatgcaaaacagagtgcatgatgaaagagcggaaacaagcaggatactatatgggttgcaacaaataacatgtaaaaggagaacagagttatgaatttaccggaaacagcaaaacttcaggaaatttacggggaaacagaaatcagcggagcacgtttcaaaaatcttgcagataatttttcaaaaatctatggacaggataaggcagaatactttacagcacctggaagaacagagatcattggtaatcatacagatcataacggtggtaaagtaattgcaggaagcattaatctggatacgataggggcagcttatccgaatggaacacaggtgatccgtatcacaagtgaaggatacagggatgaaatcgtagttgaccttacaaaactcagcaagagtaattacaaaaaaggcacagcagcacttgtagcaggaatgatggaaggtgcgcagaagaatggttttgaaacaggtggatttgatgcttatgtcagcaccaatgttattgcggcagcaggtgtcagctcttctgcttcttttgaaatgctgatctgtacgatcattgattactttttcaatgagagcaaaatgtcctttaatgattatgccaaagtaggtcagtacgcagaaaatgtatactgggacaaggcatccggaatgatggatcagatggcatgtgcagttggtggtccggtactgtttgattttgcagacagagataacctgaaatatagcaaactggatttttccttcggaaaatttggatacagacttgttattgtaaacacaggaaaaggtcatgcagatctcagtcaggaatattctgagattcctggtgagatgaaagcggttgcaaaagtacttggtgtggaacttcttcatgaaacaaatgtagatgcacttcttgaacactgcaatgaaattgaagatgacagagccgtccttcgtgcacttcatttctttggagaaacatcacgcgtagaagatgctgcagatgcgattcatcacaatgattatgacaagttccttgaactgatcgatgagtcaggaaaatcttcatgggaacttcttcagaactgctacacaatgaaagattttcatgagcagaagattaccagaacacttgcattaactcagctcttcctcaagaagatcggggcaggtgtatgccgtgttcatggaggcggttttgcaggtgttatcgcagcaatcgtgccggaaaaagaacaggataattacgtagaatatatttccagatttgttggaaaagaaaatgtatatccgatggacatccgcgcgatcggagcagtacatattggataatatgaaagataaacgacaacagttgattatcctttgaaaattattaaaatacatacataaaaaacataaggtatcataaatacagacaaaggagagattctttgaagattatttcctatatttctgtatttatgataccttttttatatcagtgatttattcttttcaagcatttcgtaaatgatattttgagtataagttccgagatgcttctgatcctctttggaaagttcttttacatagatcggtttaccgtattccagaacaacatgtgtggatttgatctttggcatatgtgcctcaaaaatttctgcggtattgttcatcgccatcgggatgatcgcacatccggatttgctggcaattttgaaacttccctcatggaacggaaggagttccagttcatccttgtttttgttccgggttccttctgggaagatgcagatggagatgccggatttgatcttttcaatagcggtaaggatggttttcagtccctgtttgatatccttacgatccagaaacaggcaatgcagatagcgcatccagttggaaagaagcggatatcgttccatttctttctttgcaatataaccggtacggatcgggcagcgactgtaggaaagtacaatgtcaaagtagcttctgtgattaccaatataaaggactggtgtgtcttttgggacattttcttcaccgattatcgtgaccttggttccggcttcccacagaataaatttaaaaactgcctggataatacgaagagagctgatctcttttgttcgcggtgaaaattttccgatgatccattccacgaaaaggattggaatagataaaatcagaaatccaatgaccgtgatggcaacaataactaaacgaatcataatgaattcctctttctgtcaaaaagatgtcccgcatagcaagactctggtacaagtataagtgattttgcaaatacttgcaataaatgttttatactctgcatagaatacatactgaagaaatctaataccgggaaatgagagaatttatgaaaaaagcagcttctctgctgtgtctggcagtgctttttcttatgttgggcggatgtcagatgatacggatcgaggaagaaaataaaacaccacttgcatataccgtgatcgaggattcccagattccggaagaaatgcaggagctgatcagagaaaagaaggaaacagaatttcagattgcctatcagaagggaacggagctgtttctggcaaaagggtatggccgacagatgcgtggaggatacagcattcaggtaaaagaactttctgcatcttcaaatgcagttttttttgaaacaaaactgatcggtccgacggaaaagattcagggcggggaaccgtcatatccgtatattgtgataaagacagaataccgggatggtccggtgcagtttcagtgagacgggaggatggaattgtggaattaaaaaaagaagatattcagatattaaggacaaagagcaaggcatccagccaggtaacatttgatgtggattacaatgtaccggatgtaaaaccggacattggacgtatgattcagaataagggggagatgacagtagaagaagtgcgcctgaatgaagggcatgcatttctgaaaggaaaactgcaggcagatcttctttatgtcggtgaggaggatggcaggatctacagtctttctgcaaatcttccaatggaagagacactgaatctggatggaatagtcaacggggataaaatgtgcctgaaatgggaaattgaggatctgagcattcatatcatccattccagaaaaatgaatattaaagcagtggttactttttttgcttctgtagatgagctgacaggagtacggcttccggtatctcttgatgatgagacagtatctgtgcagaaaaaaacaatgcgtgtactgagtcttgtaatacataaaaaggatactatgcgcctgaaagaggaaataacacttgtatcgaacaaacctaatatagcagagctgctctggtatacaacagaagttcgtggactggatctcagaccggaagaaaacagtgtaaaagccaaaggagaactttttatttttgcattatatacaggtgatgatgaaagtggaacgctccagtggatagaacattctataccatttaatggagaggtggagtgctcaggctgtatttcggaaatgatcccaaatctggaagctgctgtgatcaatcagaccctggaggtaaaaccggatgcggatggagaagaaagaaagcttcaggcagatgttgtactggaactggatatgaagctttatcaggaagaagatcatgaggtcatcatggatgtgtatacaccgtttcgtcagtgtatgccaaaaggtcggaaagagatactggaaagtcttcttgtccgtaatttctcccgatgcaggatcgcagacaggatagaagtcaaagagacacaggggaagatccttcagatctgtcacagccagggcaaaataaaaatagacaaaatccaaatcgttaaagatggaattctggcagaaggaattgtacgactaaaagtgctgtatattgtagaaaatgatgaaatgccgttttattccatggaagcaatgctgccgttcagtcacgtagttgaagccaaaggcattacagaaaacagtgtatattatctgcatacggaattggaacagctttcaacgacaatggtagacagcaatgatattgagatccgggcgacgataggactgaatgtgcttgtgatccagtgcagtgaggagatgattcttgaaaaaattgaagaaattccactggatcaggaaaaaatccgaaatatgccgggaattacagtgtatatcatgaaaccaggtgatacattgtggaatattgcgaaaaaattttatacaacggtggaggagatcatacagatgaataatctggacagggatgaggtatcttccggaacaccacttcttctggtgaaaaaagtcgaagaataatattgaatttagtatgaaaatcggctaaaatatagccagatcatgtttgtatacaaagtacaaaggaacgaaaagtacaaaggatggaaggtgaatttatgcgtttacgtgcaatggccaagattaatctgggactggatgttcttcgcaaaagagaggatggatatcatgaggttcgaatgatcatgcagacgatccagatgtatgatcttctggatatccggaagaaggaagaaccggggatctccttatctaccaatcttccatatgtcccgtcagatgaaagaaatctggtatataaagcagcaaaacttcttatggatgaatttgatatcaaagaaggcctttctatgaagctgacgaaatttattccggtggcagctggtatggctggaggaagctcggatgcagcagcagcatttgtaggagtgaatcgtctgtttcgtcttggattaagtgaagaggaactgatgaagagggcagtacaggttggtgcggatgttccgtattgtgttatgcgtggaactgcacttgcagaaggaattggagagaagctgaccagacttccgggactgccgaaatgctatgtgttggttggtaaaccgggaatcaatgtttccacaaaacttgcctatgagaatcttcatctggatcagattcagtcacacccggatattgatggaatgatcagtgacattgagaatcaggatcttcacagtcttactgcgaaaatgcaaaatgtttttgaaccgggaatcatcagtcagtatccggttattcaggagattaaagatcttatggaagcgaacggtgcgcttaaggcaatgatgagcggaagcggcccgactgtctttggaatatttgatgaccgcagtaaacttcgggaagctacggaagcgcttcgcaacagtcatctggcgaaaactgtatttgcaacacagatatacaataaaaagtaagaaaggggaagtacttatgataaatgatttttctgtagacatgaatgaatatctgccattacgcgatgttgtatttaatacactccgtaaagcaattttaaaaggtgaactgaagccaggagaacgactgatggaaattgcacttgcagaacgtcttggtgtcagcaggactccggtaagggaagctatgcgaaaactggaactggaaggtctggttgtgatgattccccgaagaggtgcacaggttgccaatatcacagagaaagatctgaatgatgttctggaagttcgaattgcgctggaaaatctttctattgaaaatgcatgtgcacgtatgacagaggaacagctggcggaattgtggaaagcggccaaagacttcgaagcaactatggcagagggtaatctggtcaagcttgcagaggccgatgtggcatttcacgaagtgatttataaatcttctgataacagaagactgaatcaggtattgaataatcttcgggaacagatttatcgttaccgtgtggagtatctgaaggatgaagagacaagaaatcttctcgtcaaagaacatgaagaaatttacgaagcaatccgtaatcgtgatgtaaaacaggcacaggagatttcctatcagcatattgagaatcagcgggaggcgatcatacggtctatccgtgaagagacacagaatcgacaggttcataaataaaacggtcagcagtgtctgcacacataaaatcttataatctggttattctaaaagagatgcataaagtgtatctctttttttattctcaattttattatagcaggtatctgtcttcaggaggaaatgatgagagaagcagtagaaggaccagtagaaggatcagtaaaagaaacagagcagatcaggatttcgtcaaatctgagggataatgagatatatatccgaaagcaatgcgaaaattgtgcagatattctggtacgtccgatgcgtctgggagaagatcgtaaagtggactgccttatggtttatattgaagttacggtatcgaatatgatgctggatgattcagcgattggaaaaatgatcaatcatttctggaaaataccgccggaaaaaatacaggaatttctcaaaaataacagtctgggcattgcagatgtgcagaaactggaaaatatggatgaagtttttggagcaatcctgtctggaaatgcagtgttttttatagatggttacaataaggcaatgaaaatctccagcaaagggtacccggatatgggagtctctgaggcagaatcagaaaaggtattgcgtggttccagggaaggtttctcggattcagtaaaaacaaattctgcgcttgtacgcaaaaggatccgtgatacccgaatgaaagtagaagaatatcagagtggagtccgttccaatacaacgattcagatactgtatatcgaagatctggtacatgaagaacttctggaagaggtcaaaaacaggctggaagaatacaaaatagatggaattctggacagtggaatgctggaacagctgactgagaaaccctggtattcgccttttccgcagtatcaggtgacggaacgcccggatcggacggcactggaacttctcaatggaaaaatcgcacttctgtgtgataattctccgtctgccctgatcctgccaggtgcattcagcagttttatggagagcagtgaagactggtatcatcattttgagatggcaacatttcttcgaatactgcgttatctggcattgctgacagcaacattgcttccgggattgtatctggcagtgatccggtttcatacacagatattgccaacgaatcttttgctgtcttttgcagatgcaagggagggagtacctttttcaagtgtgacagaactggttttactggaactcgcttttgaactgatacgggaagccggagtccgggtacccggtgcacttggaaatgcaatcggaatagtaggcggcctgatcataggagatgcggcagtcagtgccaatctggtaagtcctattgttgttatgatcgtagcacttacggcacttggatccatggttataccggatgaagaatttgcagctgcttttcgcctgctgaaatatggatttttgattctgggaggctatcttggaatatatggagttgtccttggcatctatcttacagtatcacatctgtcaggactgttgagctttggaataccgtatctggtgccttttgtggaagaacaatccgttagacagacaggtaatggtatttttcgaatacctttcaaagccagaaaatacaggccggtctatgcaagaaaggaacagagtatccgtctgcgaaagattacagacaggaaggagcgtgaatcatgaagtatgcagaaaacaatcgtatatcacacagacagttgtatcatcagattatactttcttttcttgcaccacttctgatctgtattccgggatataacggagaacagggactgtctggagcagtgggcatcatggctgcagttctgatccttttgctgtatgtcttttttctgatgagaacttcttactgttatgcagatcctgtaaaaataatgggaaagctgaaaggcagcctgttgggaagctttttcttaatatatctgatcatgacaggagtttatattctttcactcattgagcagatcgtaccggtgtgggcagtatcagggattgcaactggatggctgattttctgggcggttgtagtctgtgcatatggtgcggatcaggggatgcagcgcagagggcggatggctggtgtctcgggaggaatttttttatttgtgatcatacttatgctgctgttgtgtatcgggcaggggaatgcagaatatttgaaagaaatgctgcgggaaagtcgattgtggggaaaggagatcgtttacagcacgtatgatgtggtgtgtgctttttcgggaatcagccttcttccgtttgtattgcagaatgttgaaaaaagaggaaattccggaaaaatcgtaacatcggccattcttacagtcagcggaattttactgcttattctttttatcctgccttctgtattggggtggggacggatacagaaagaactttatccggtccttccgctgatggcaggagcagacctgccgggaaatgtacttgccaggtttgatgtactctggattggtcttttattgtacgggcttttttttgcactgggaagctgttttcattacggaatccgtatactggatacggtgcatctgagaaacggaaaatactggcttcccatagtaatctatgcgttttcttttgtcagaataaatgacagcgggatcgcagatttctacaaaatgtatctgggaacattttttgttccgggactggtgctgatccagatctgtctgcttttccggggacagaaaaagagaagaaaaaaaacagcttctgcagtggctgttttaatggtatttattctgagctgtaccggttgtgccggaatagaaccggaaaagagaatgtatccgctggctatgggagttgatgtgtctgagggagaatacattctgacctatgcaatgccggatcttcccagagcgaccggtcagggaaaagaggaagaggatggcaatcagacacttcaggtccgtgggaaaagttttgaggaaataaaaagtcgttatgaaagatcccaggagaaatatctggatatcggacatttgcagatactgatactgagtcaggacctgactgaaaccgatatgtggaaagatttttttgaatatctcagagaagaaccgctggcaggagaaaatatatatgtatttcagacgcaggaaccggaaaaactgctgggctggaaggaaggtggaacatcggtcggagaatatattacaggtcttatggaaaaccgaatggacagagaacagaaaaatggtgtgactctgcggaaagtctattatcagtggtatcagaatggaactttaaagaaacttccgaaaattacactttccgaagatcagatccaggtctggctggaataatatggcgattttggggaatacttctgaaagaatattattttgcaaagcaaataacaaaaagaaacaggaggtcccgggatgaaacagatatacaaaaaagaaaacagaatactgctctctatgataacaggaatgatagtcatcagtctgctgtgtggaatacaatggaggggatcgcagaaaaatgttctggcatggtggggcagtatttatccggagttctgtttttcagaatgggatcagtatggctgcgatgtcgaaaaatttccatcagaacagaggccaaagatatccttctggcttgcgaaagctattgagaggtggtaagatatcgatatgttcggaaaagttcattttactttttcgaacatataaaacagaactggagaattacatatgaagatagatagagatgcaccgatcggtgtgtttgattccggagtaggtggcctgacagtggcacgtgagatcatgcgtaatcttccttcggaaaagattgtttattttggtgatacagccagagttccatatggcagtaaatccagagatacggttattcgctactccagacagatcattcattttctgaaagaacagcaggtgaaagcaattgtgattgcctgtaacacagcaagtgcatttgcgcttgatgcggtacagcatgaacagaatataccggttcttggtgtgattggagcaggagcaaaggttgctgcagaagagacggtcaataaaagagttggtgtgatcggtacggtcggcacagttggcagtggaattcacgaagcttatctgaagaaactggatccggaaattacggtgatcggtaaggcctgcccactgtttgtacctctggtagaggaaggctggctgcatgatccggtgaccgtagaagttgcaaaccgatatctgcaggaactgaaagataaagatgtggatacactgattctcggctgtacgcattatccgctgattcgatctacgatccgggaagttatgggagaaaaagtaagactggtaaatccggcgtatgagacggctttggaactgaagaatcttctgcagaaaacaaatatgctcagtaccggacagcaggaagaggaatttccttatcgattttatgtaagtgatcttgcagatgagtttaaggaatttgccaattcgattcttccgtatgatgtggaaatgactaagaaaattgatattgaaaaatattgataattatcagaatcaggagagatatatgaaaaaagatgtacttatacatgtacgcggacttcagatgatggatccggaagaggaacaggaaccaatcgagatcgttgtcccgggacagtattattatcgaaatggaagtcattatcttcgttatgaagaaatgatggacgatacggcagaaccgacggtcaactatatcaagatgtcggcgcagggagtggaagtccgcaagcaggggcaggtaaatgtacatatggttttcgaacagggtaagaaaaatatgacattttattctacaccgtttggaacacttcagatggggattgcagcaaccggtttggaattgcaggaagaagaggataatattcatctgaaagttgattatgcactggatatgaatgaggaacatgtggctgactgctatcttacggttcaggcacagtccagagattcggagaatcttatattgtaataagtattgatagaactaaagagaaaaaagaaatgcctgggagatgattctctcaggcattttgcatgtgtccttatttgttgagtaatcttttgaaaaagccttttttcttaggagccggtgtttccagggaaccacggattcctttaacgccaacgatatataaaccgctgacttcggccttgacttcttttttgaccggaatctgatcaaaaactttttcatctgcgatcagaacggagatctttggtccgacttttgctttaacgattggcagtttggaacggcgcatcagcttcggtgcctggtcgatcaccatctgaggaagaccggattcttttaacggaagtcgcttcttatcaataatcagcatagaaacggtttgcttagcagcttcaatctgggcctgctgttcttcttgtttcttctgagccttttttccaaagaaataaagagctatcagagcagcgatcagaacgaccaggatcacaagaaggacgatggtaagtgtactcatagataccctcctcaatatgtaatttacaaacttatgtcatgcgaattatattctaacatcatttattacaaaaggcaaacaaattcataaaattccataaagaacaggaaaagttatagcaaaggtacagagaaacaggtataataaatttacggtttttagaaaaatctgaaagataaatttatttgtgggtacactaagaattacagaacaaaggccctggagagttagtatggagaagaaaaacgacagaaataaaaataccagtcagaataaactgtattcagatgaaataaaagaaatggaacgtttgtcagaagagcaggaaaaggcacttcgcgagagacgtcaggcaagaaaacatcgcataaaaaagcaggaacgaagaaaaaaactgatcgtattgggaagcatggccgttgttaccgtagtggtagcagtgagtgcagtcaccggaatcgtcagttttgtgaccagagaaagcaggcaaagtcaggtttcatcaaaaaaatcagcagaaaaggactcatcggagccgactttgacagatacggtgaaacagagtcgttcagatctggaagtggatgagagaaccccggaggaaattctggcagatgcgaagcttctcgcagtacaatatgattatgacaaggcaatcagcctgcttcagaaatacagtggctataaaaagaatacagaaatgcaggatgcggtaaaacaatatgaagaaataaaagcttcctgtaagtcctggccactggaagaagttacacatgttttttatcatacactgatcaaagatccatctaaagcatttgatggagactataaagaagctgattacaatcaagttatgacaacaatcgatgaattcaacaagattacagagactatgtatgagaaaggctatgtcatggtcagtatctatgatatggctaaggcagatgctgatggcaatataacagaaggagagatccttctcccggaagggaagattccgtttgttctttcacaggacgatgtctgttattatcattatatggatggtgatggatatgcatcgaagctggttgttgatgagaatggaaaaatccggaacgaatatatagaggatgatggaagcgtttctgtcggagattatgatatggttccactgatcgaccgttttgtagaagaacatccggatttttcatacagaggagcaaaaggaattgtggcacttaccggttataatggtattttaggatatcgtacagaccagagctatgagacacgtccggatgatctggatgccaataaggttgaatggttggatgcacatcctgatttcagtctggcgaaagaaagagagggcgccaagaaagtcgcagatgccatgaaagcagagggatggctttttgcaagtcacacctgggggcatcagaatgtagggcagataggactggaaacacttcagaccgatacccggaaattcaaagataatgtagatccgctgatcggaggtacagatatcattatatttgcgtttggtacagacctctgtggaccggaggattatcacggcgataaattcgaatatttaaaaggtgcaggatacaattatttttgcaatgtagattcaagtaaatattatgtacagataagagagcggtatttccgtcaggggagaagaaatttggacggataccgtatgtattaccacccggagcttctggaggatctttttgatgtaaagagtgtttttgatccggtaagaccgacaccggtgccgccaatggcataactgataaaaggggataaagaatgaaaaaaagagcattaatacttacagcagtacttactgcagcagcactgacagggggaagtggttatctgccggttacagacggcataagatctaaaatgatacagaacgtttatgcagatgcagaggattcaaaagaatctgcagacacagaaacttctgattctgtgcttgatcaggcaacgatcatgtatcagcagtataattatgatgaggcaatcaaattgctgaaaaagcaggatgattttacaaaaaataaagattacatggatcttgctgcaaaatgccagattgcgaaaaaatcactggttgaatatcctcttgaaaaaatcacacatgtattttttcatacattgatcgaggacacatccagagcatttgatggagattcaaaatccggaaattataatcaggtcatgacaacagtcagtgagtttaataagatcattcagatcatgtatgacaagggctatgtactggtaagtccacatgatatggcaacggtaaataaagacggtacgatgagcaggggcaagatcatggttccggagggtaagattccgtttgtcctttcgcaggatgatgtcagctattaccattatatggacggcgatggctgtgcatccaaacttgtacttgacgagaatggagaggtaaagaacgaatatgttgatgctgacggaaatgttttagtcggagattatgatctggtaccgcttctggattcttttatcaaagaacatccggatttttcctatcatggacgtaagggaatccttgcgatgaccggttataacggagtactgggatacagaacagacagtgcatataagaccggcgaaaaccttcaggatgaccagaagaaattcctggaagatcatcctgatttcgattatgaccaggatgtaaaagatgcgaccaaagtggcagatgccatgaaggcagagggatgggaattcgcaagccatacctggggacatatgaatgcaacagagcgttctgctgaggatcttaagacagacgatgagaaatggaaagcaaatgtagccccgatccttggagatacagatatgatcatctttgcgtttggtgcagatattggtgactgggaaggttactcttctgataatccgaaatttcagtattataagaatgcaggctatgattacttctgtaatgtagattccagtcagtactttgtacagatcacagatcagtatttccgacagggaagaagaaatctggatggttacagaatgtattataacccggatatgctgagcgatctttttgatgtatctgaggtatgggattcttccagaccgacaccagtaccagaaatgtgatatgcagatttgaaaggagttttattatgaagaaaaaaacagttgcagcgatgttggtaatgtgcatggctttatctgccacagcatgtggcggatctgatacaaaagaaaccaaaaccgagacaacacaggatacaggggataaaaaagattctgcatcctcagataaaaaaacatctgcttcggcagtcagactggtgtctgtttctgatgtttcaaaatatgttacgattggagaatataagggactgacactggacagatcatcggttactgtaacggatgatgatgtacaggcagagatcgattataatcttgaagaaaacggaacagaggtaaatgacggaacagtagaagagggcgattcggtaacgattaattttaccggaacgatagacggaaaagaatttgatgggggttctgcagaagattatgatcttgtgattggcgagggcggaatgatcgatggattcgaggatggaatcattggcatgaaaaagggagagacaaaagaactggacctgactttcccggatgattactatgaagaatctgttgccggtaaaccggttgtgtttaaagttacgctgcagaagttcacgcggccttccgaactgaatgatgagtgggtagctgccaatacagaatacaagacagttgacgagtatcgtgcagccgtcaaaaaagaactcgaagaaaatgagacaaaatcggcagattatgatctttacagtaatgcttggagcgaagtactcgcaaattctaaagtaaaagaatatccggaagaagatgtggataaggcggttgaagcatacaaaaaactcaatgaaaattatgtcaaagaagcaggtatggaaatgtctgatttccttaaggctcagggaatgtctgaagaagattatgaggaagactgccagcagtatgcagaatccaaagtggaacagaaccttattgttcagggaatcatggatgcagaaggactcagtcttgacgatgacgatatacagacattaaaagacgagctgttatcagaatatggctatgagagttttgatcagctggttgcatattatggtgaacaggaagtaaatgaatcactggcactgatgcgtgtggaacgttttatagtggataatgcgacagtaaatgaaacttctgcaacagaagctgatgtggcaaatgaagatgcagatccggaaagtgaagacaccggagttgatgctgcagaagacactacagaagataatgcgtcagaggaagatagcagtgacactgcagaagaaagtgaggaaactgcatcggaagatgatgtggcaaatgaaggatgatcataaaaaatggaaatgtttttcaggaagatggaagtttttgcagggaaacactttatatcagaaatcacagactgacagaggcatttgaagaaacatctgaagaggaagttatagatgccgagggccttatagtcattcccggtcttgtggatattcacagccatggagcatatggggaagatttttctgatggtgatccggagggcctgaaaaaaatcttaagatatgagagacaaagtggaataacatcatattgtccgacttccatgacacttccgaaggaacagcttaagaagattttcaaagggatcagggaagcagaaaagtccggcgatggagcaacggttgcaggtatcaatatggaaggaccgtttctggatcctgttaagaagggcgcacatgtggaagaatggatcacagaaccggatgcagattttgtaaaggaattgaatgaagtatcaggtggaagaatccgacttgtaacactggcaccgaatgtaaaaggagctatggacttcatacgggaaatgaaggaagaagtacagatatctttgggacatacagcggcagattatgaatgtgcggcagaagcaatggcactgggagcacatcacgtaacgcatctttataatgcgatgcagccattggctcacagagaaccgggactgatcggagcggcttcggatgatccggaatgtatggttgaactgatctgtgatggctatcatattcatccggctgtaatcagagcgacattcagaatgttcggaccggaaagagtcattttgatcagtgattccatgcgtgcaacagggatgaaaaacggtacatatgagcttggcggacaggaagtaactgtgaaggaccgcaaggcagtgctgaaagacggaacacttgcaggatctgcgacaaatttatttggctgtatgtgcaaagcaatagaatttggtgtgcctgtagaccaggcaatttttgcagccacgagaaatccggcaagaagtattgggatttatgacagaacagggtctgttcatacaggtaaagaggcagatattcttctgttaacagagaattttgaattaaaaagagttatctgatatacctgctgaagtattggatcatcattcacagaataacttgatttagttcaggaattgtgattgtatttcagaattaaatgcgttatgataataaatagacaaaaaagttatagaaaatacagcaggtggagtagatggataaaagggtattgcgtgaacgaatgcgcaaaaagcaacagcagataagacgtcgtcagatgatgaaaaaaggcgcgtatgttgtggctgtgatactcgtattcatatttgtaatacggggaattattcttccggtcattaatcgggtcggagggaaaaatacagataaaccggcacaggtacaggcagaaacagatacgaatgcgaataccaatacaggagattcaggaactgagacacagatagaaaaagacacaaatgcagcaatccgtaaaccgctgaagggtgcgagtgatctgacaaaggcttctcagctgactgctggctggcatgaggatgagaacggtaaatggtatcagaatgtggatggtacatattatgcaggtggactgcaggaaatagatggttctacatattattttggagacaatggttatgcacagaccggatgggtgagcgttggatttgatgattactatttcaatgatgacggtacttatgatccgagccagcataaaaccagaatcgcatttacctttgatgatggccctggagaatataccaatgaacttctggactgtctggaacagaacaatgcacatgctactttctttatgttaggtcagaatgtaggcagctgggagtcagaagttcagcgaatggtggacattggatgtgaggtcggatctcattcctgggatcatctgaatctgtatgatcttgatatggatgcagttgccaaagagttttcagatacagatgcagctctggagaaggcatgtggacagaaggcaagtgttgccagagcaccatatggaaactggagtgatgatatcatttctacagtcaataagccattctttacatggtcactggactctctggactggagctatcttgatgtcaacaaggactatgatgctgttatgaatggggatcttacagacggttctatcattcttatgcatgatattcatgagccatctgtacaggcagcaatcaagatgatcccggaactggtagccaaaggctataaactgatgacagtcagtgagcttgcagcagccaagggagttactttacagaatgcaaactattctgatttctgggacagttcacttcagaagggtatcgttgcaggatataacagtggttcttctgacggaagcagtgatggtacagcggtatcagatggtactacctcagatgacggctcaacagatagttctgatgtaagtgatacaggatcttcggacagcagtgatgtcagcgatggaagtgatgatagttcagatgattcttccgaagatgacagctcaggaggcgatgactcttccggggatggaagttcatcagatgacagttccggagataacagctcagacgatggatcttatgatgacagttccggagacggaagtgattatgcagatgaggactccggagatgggtatgatacaggatattaattctatataaaataagaatccacaaaagaggacaagttcgaaagcgcaatcggacaagtcctctttttgtgtacttgtaatttcttattttaattgacgggaacattatggattggtataatatgtctataaaaatgcaaaatatcagcataataaatgtgcataatgctgatgggaggcgcagagttgtaaagagtgccggaataaaatagctgttaagggaggtacgtttgaatgggagagaagttgcagtttacagagctggatcagtatctgttcggacagggaacccattatgacatttacaggaaattaggagcccatccgacgatacagaggcgtaagaaaggtgtatattttgctgtgtgggcaccaaatgccagatcagtttctgttgttggagagtttaataactggaatacacaggcaaatccaatgaagaaagtcggaccaattggggtatatgagacatttatacccggagcaaaggttggagatctctataaattctatattatcggctatcatggtgaagaattatacaaagctgatccatatggcaatgaagcagaactgagacctggcactgcatccagaattgcggacatttctgattataaatggaaagatactacctggatgaaaagacgtccggaatttgatgaaatcagagatcctatggccatttatgaggtacaccccggttcctggaagaaacatgaagcaaaagatgaagatgatccgggattttataattaccgtgaactggcacatgaacttgctgcctatgtaaagaaaatgggttatacacatgtagaacttatgggaattgccgagcatccgtttgatggctcatggggatatcaggtcacaggatattatgcaccaacctcccgttatggttctgttcaggatttcaagtatatgatcaattatctgcaccgtaataagattggagttattctggactgggtaccggcacattttccgaaagatgcacaaggcctcgcaaattttgacggtacagcagtatatgaacatgaagatccgagacagggagaacatccggactggggaaccaagatttataactatggccgtccggaggtcaaaaacttcctgattgccaatgcactctactggattgaagagtgtcatgtagacggacttcgtgttgatgcagtagcatctatgctttatctggattatggaaagaaggatggcgagtgggttgctaataaatatggtgataacaaaaaccttgaagcaattgagtttttcaaacatttgaataccgttgtacttggaagaaatcatggaacggtcatgatagcagaagagtctaccgcatggccacaggttaccggaaaagctgaagatggaggacttggattctctttgaaatggaatatgggatggatgaatgattttcttgaatacatgaaattggatccatatttccgtaaggacaatcacaataagatgacattttctatgacttatgcatacagtgaaaaatatgtccttgtcatctcgcatgacgaagttgtacatttgaaatgttctatggttaataagatgccaggctatccggaagaaaagattcgtaatttgaaagctgcgtatgcatttatgctgttccatccaggcaaaaaacttctgtttatgggacaggaatttggacagctgcgtgaatggagtgaggagagggagcttgactggtatcttctgaatgaaaaaccacatcaggatcttcaggagtttgtaaagacgcttttacatatgtatacaaagtatcctgcattgtatgcaggggacaacgatcctgacggatttgagtggatcaatgcagacgatgcatacagaagtattttcagtctggtaagaaaatctcctacaaagagaaataaccttctgtttattgtaaactttacgccggttgaccgcccggattatcgtgtcggtgttccaaagaaaaaacagtataaactgatcatgaatgaacatggacttttggagaaaccggaggtatttaaagcagaggcacaggaatgtgatcacagagagttttcgtttgactatccactgccaggatatggtgttgcggtgtttacttattgacaattccattgtaaaaattaaccaattttgcgcatcgataattatataaatttaacaaataaaatcgttgcaatttaagaaaatataggttatactgaacgcgactgaggaaaatcatttggaaactcagtatttacatgaaatgcagtaagttgaacataaaaaataaagattttgaaaggagatttacaatgaaagtatctaatattaaagacatcgagaaattttttgaagtagtagacagctgccagggcaaagttgaactggtaacaggtgaaggtgacagactgaacctcaaatccaaactgtcccagtacgtatctcttgcaaacatcttctccggcggagaaattccggaacttgagatcgtagcatatgagaaagaagatatcgacaaacttctcagcttcatgatcaacggttgattttagagagtatagagtggggacgtgactggttcatgtccccattacccatataaagggataataaccagggggtattttatgcctcctggtcaaattgcgttataagttagcgatataaaacaaataatataaagtaatttagcaatcattttgcccatgggcagaaagagaggaaatgcaatcatggaaaaaactaaaattgacattatctccggtttccttggagccggtaaaacaacactaatcaagaaacttctgaaagatgcctttcagggggagcaggtcgtactgattgaaaatgaatttggtgagatcggcattgatggaggatttctgaaagaagccggaatccagatccgtgaaatgaactcaggatgtatctgttgttcactggttggtgattttggtgcatctttgaaagaagttatcagtaaatatcacccggacagaatcctgatcgagccatctggtgtcggcaaattatctgatgtcattaaagcagtacagggcgtagaagaagaaacaggactggttctgaacagctacactactgttgttgatgcaaagaaatgcaaaatgtatatgagaaatttcggtgaatttttcaacaatcaggttgaatatgccggagcgatcatcatgagccgtacagatattgttgacgaagcaaaagcacaggcatcactggaactgcttcgtgagattaactccaaagcagcgatcatcacaacaccaatcgagaaactggaaggtaaaaaacttctggaggttatggagcatccggtatctctggcagatgagctgatggaagaagaggaggtatgcccggaatgcggacatgtgcatgaacatggcgaacatcatcatcatgaccatgatgaagaatgtggatgcggacatgaccacgcgcatgaagaacatgagcatcatcatcacgaccatgatcatgaatgcggatgcggacatgaccacgatcatgaagaacatgagcatcatcatcacgaccatgatcatgaatgcggatgcggacatgaccatcatgaccatcaccatcatcatgcagatgaagtatttacaagttggggtcgtgagacaattaagaaatatacaaaagaaaatcttgagaagatgctggaagctctttctgcatctgatgaatatggaatcattctccgtgcaaaaggaatgcttccggcagaagatggaacatggatttatttcgatatggttccggaagaaacagaaatccgtgaaggcgcaccggaatatacaggtcgtctctgcgtgatcggatctaaattgaatgaggacaaactggctgagctttttggcctgtaatcatagaggagaatacagacaatggatgagatcaaagtaccgatttatttaatgaccggtttcctggaaagtggcaagacttctttcctgagttttaccatacagcaggattatttccatacggatggaaagacacttctgatcctctgtgaggaaggggaggaagaatacgatccggcaattcttgaagccaataatactgttgtggaggtaattgaaaatgaggaagactttacaacagacagactggttgccatggatattcttcatcagccggagcgtgttatcatagaatataatggcatgtggctggtaagcaattttgaaaaaatgcagctgccgacaggctggggagtagaacagcagattacctgtgtagatggaagtactttccagatgtatatggcgaatatgaaatccatttttatggatatgataaaaaatacagatatggttatcttcaaccgttgcaaaaaggaagatccacttccgacttatcgacgtggaatcaaggtcgcaaatcagagagcagaagttatctttgaggatgaagaaggcgagctgggtgatattttccaggatgaaatgccatttgatatgaatgcgccggttatcgagattcttccggaagattatggcatctggtttgtggatgcaatggatcatccggaaaattatgaaggcaaaacagtcaagtttaaagcaagagtcatgaaacctcgcggaatgggaagtaaattctttgttccgggacgtacagccatgacttgctgtgcagatgatactacatttcttggttatgtatgtaagagcgcatatgcgccgaaactgacgccgggagaatgggtagaagttacagccaaagtcggcattgagaaacgtaacgaataccagggtgaagaaggtatcgtacttgctgcggagcatgtagagcagtgtgatccactggaagacgaaatggtttattttaattaatacagcgaggaaattctgatgtatctgatcgtaggtttgggaaatcccggaaggcagtatgaagccacacgccataatatgggatttgatgtgattgataagcttgtggaggaatataatgttccacagtctggcgtgaaattcaatgccatgtacggaaagggaagaatcgaaggacaacctgtcattctgatgaagccgctttcttatatgaatctcagtggtggtcctgtccgggatatggcaaactacttcaaaatcgatccggagacagagatgatcgttatttatgacgatattgatctggaaccgggacagcttcgtatccgtaagaaaggcagtgccggcgggcacaatggaatcaagcatatcattcaacagcttggtacacagacgtttgttcgtatcaaggttggtgtcggagccaaaccaaaaggatgggatctggcagatcatgtacttggcagattcggaagcaatgaacgtaagcttgtggaagaggcgcaggagagagcctgcaaagctgtagagatgatcctggctgacagtgtggatgcggccatgaaccagttcaacaagaaaatggagaatgtatgaagacatttttgcagcctctgcagaatcttgcagagatggaagaaatacaaaaacaggcaaaaaagaatcgtggaattctggagatcagtggttgtatggagtcccagaaagctcatcttatgtatgggctttccgggctttttccatgtcatctggtaattgccgcagatgaaaaatctgcgaaagaactgtatgaagattatcgtttttatgataaacgtgtttattactatccggcaaaggatcttcttttttttcaggcagatatacatgggaatctgctgattcgtcagcgaatgcaggtgattcgcgctcttctagaacgtgaggatgagattacggtcgttaccagtattgatggctgtatggactatcttgcacctctggaaaaaatagaaaaacaactgattcattttcgcaacgacagtaccctggatatggataaactgacagctgcgcttgtccatatggggtatgaacgtgttggacaggtagagatgccaggacagttttccatccgtggaggaattattgatatttattctctgacagaagaaaatccctggcgtattgaactgtggggagatgaaattgattcgatccgcagttttgatgcacagagccagcgttctcttgaaaacctggatgatgttacaatttatcctgcagcagaacagccaatggagaaaaatggtgtctcatttctcgattattttaaagaaactgaaactctgttttttttggatgaacttaatcatctggaggaaaatgcaaaagctgtgcaggaggaattccagcaaagttgtgagaatcgaaaggaaaagggcgagatcagtctttccggtgactggatgtgtacatgggaggaattgtgttataagataaatgacagaaattgtgttgccatgtctttgctggatccgaagaaatctaactggaaaatttcagatcagtttaatatcacagtaaaatctatgagctcttatcaaagcagttttgaactgttggtaaaggatctgaaacagtacaaaaaagaaggatatcagatcgttttgctgtccggttccagaacccgtgcagaacgtctggcaaaagatcttcaggaagaaggtctgaacgcattctacggacaggattctgatcgtattctgcagccgggagagatcatggtggcgtatggccatgcacagaggggatttgaatatccgctggttaaatttgcagtcatcacagagacagatatctttggaaaagagcagaaaaagcgtaaaaagaaaaaagaatacaatggaaagagaatccaggacttttcggaactttccattggagactatgtagtgcatgaaaagcatggactcggcatttacaaaggtattgagaaagttgcagtagataaagttgcaaaggattatatcaaaatcgaatatcgtaatggaagtaatctgtatattcttgcaacacagctggatgcactgcagaaatattccggggcagaaacagcaaaaccgccgaaactgaatcggcttggtgggcaggaatggaaaaagacgaaatccagagtccgcggtgccgtgcagaatattgcaagggaacttgtggagctttatgcagtccgccaggaaaaagaaggttatgtctgtggaccagataccgtctggcagcgagagtttgaagagatgtttccgtatgaggaaacagaagatcagctggctgcgatcgaagatactaagaaagatatggagagcaccaagattatggaccgtcttgtgtgtggggatgtcggatatggcaagacagaggttgcgctgcgagctgcgtttaaagcagttcaggaaagtcgccaggttgtttatcttgtaccgaccacgattcttgcacagcaggtttataacacctttattcagcgaatgaaagagtttccggtgagagtagatcttctttgccgattccgtacggctgcgcagcagaaaaagacgatcgcagatctgaaaaaaggtcaggtggatatcgtagtcggtacacacagagtactttcgaaggatgtggaatataaaaatctgggacttcttatcatcgatgaagaacagcgttttggtgtggttcataaagaaaagatcaaacagctgaaaaaagatattgatgtactgacgttaacggcaacaccgattccgcgaacactccatatgagtatgatcggtatccgcgacatgagtgtcctggaagagcctccgatggatcgtgttccgattcagacatatgttatggagtatgatgaggaaacggtaagagaggcgatcaaccgtgagcttcgaagaggcggtcaggtttattatgtttataaccgcgtgaatgatattgcagatgtgacggcaaggatcgcgaagcttctgccggatgcgagagtggattttgcccatggacagatgagtgagcgagagctggaagcagtcatgtatgcatttattaacggagatatagatgtactggtttctacaacgatcattgagaccggactggatatttccaatgtcaatacgatgatcattcatgattctgaccgatatggactttcacagctgtatcagcttcgtggaagaatcggacgttcaaatcggactgcttatgcattccttatgtatcgcaggaatacgatgttgaaagagactgcagaaaaaagactttctgcgattcgagaatatacagatctgggaagtggattcaagattgcaatgcgtgatctggaactcagaggcgccggaaatcttctgggagcagaacagcatgggcatatgaatgcagtagggtatgacctttactgcaagatgctcagtgaggcagtcaaggaggcaaagggtatccatacaatggaagattttgagacaacgatcgatctgaatatggatgcatttataccggattcttatatcagcaatgagtatcagaaactggatatttataagaggattgccggaattgagacacagcaggattatgatgatatgctggaagaattgctggatcgattcggtgaaatgccaaaagcagttctgaatcttcttgtgatcgccagaatgaaagcacaggcacaccgatgttatgtggtggagatcaaacagatcgctggggatatgaagattacattgtatgaacgggccaaactgaatcctgcaggtattcctgtactgatgcagaaatatagaagagggctgcaattcaagaatgaacaggaacccaaatttattttcactccggagggagctggaaatacactgacagctctgacagattttctgacggaactggaatcacttgtagaagaataaaatccatatagtctgattaagaggagaatctgtgaaatatccgtgaaaaacggctatttttatgattctccttgctcttaaaggcaaaaaagtttatactcttatttatatgctagaattgtaaagcaatggaggaagagatgaaaacaatgacaaagagaacagctgttgcagctcttaccggtgtaatggcagtggggatgctcacaggctgtggagaaaagaaattagatggaacaaaaacagttgcaacagtggatggaacagaaatcccgcttggaatcgtgagtctttctgtaagagaaggacaggcacagacagaagcaatgtataagagctttatgggcggacaggattattctatctggagcatggatgcagaagacggaaagacctatggagaacaggcagtagaacagtctctgaaagatgtagagctgatgtacatcatgaaagaaaaggctgcagactataatgtagaagttacagatgatgatgagcagaagatcgcagatgcagcagcagcatttatggctgccaacagtgaagagacactgcaggagcttgcggtaagtgaagatcaggtcaagacatatctggagcttcagacttataagagcagaatgcatgatccgctcattgcagatgtagataaagatgtttctgatgaagaagcacagcagtcatcttttgattatgtaagcatcagtacagcagatctcagcgatgatgagatcaaacagaaaaaagaagatgcacagaagatcctggatgatctgaaagcagctggttccgatggagatctgaatgaaattgcaaaatcagtggatgattcttattcttccgtaagtggtacttttgatgtgaatgaagatgcggcaaaagaagattctgatgaagagtccgacagcagttcttccagcagtgcatatccggatgaggttatgaaagttctcagaactctgaaagacggagaaatcggtccggacgttattgagacagatacttcttactatgtagtaaaacttgataaagtaaatgatgaagaagctacagagactaagaaacagtcaattatctcgacaagagagaataagctttatacagacacaacagaaaaatggctggatgatgcagacatcaatgttgagaaaaaggttctcaagactctgaaggttacggataatcataaattctcaatcgcaactgcaacacctgaaccgacagaagaggctgcagcaacagaaacaccggaggttacagaggcagcagaagaaacagaggcaacggctactccggaagctacagaggagactgaggctacaacaactccggaagttacagaagcagcttcctataatacagattcttctcttgaagttacagatggaaacaaggtcaatattgattatgtaggaaagattgacggagttgcatttgatggtggaagcacagatggtaaaggaacaagatctggtaatcggttccggtacatatattgataattttgaagagcagctgatcggtgcacatccgggagataaagtagaagtaactgttgtattcccagatgattatcaggcagcagatcttgctggcaaagaagcagtatttgatgttactgtaaatggaatttatgaataaatgacatgtaataagccctcgcatttgcgggggcttattgtttgaaaatcttaggattctgtactttcgctgtttccactggaaacatggataccattgatctctacatcaccttccattggaataacaatgcatttacgcccatcaatcacctgcgtttcgatcagcgcggcacgatcaggatcaatgtgaattacaacatccggtgttttgatctcagtacgtcgtgtattggtaatattggcagccataagtgaagcgttttcaccggcaattgcttcataggtctgatcaaaagtttcgagtttttcattttcaacaccgcattcttcaaagagacgtttcacttccggtttagtcagtacagcaggatccggggaatccttctgagaatctacccattcattcagtttctcatggatattcatgacagtatcgtaggcacagtcctcgccaagggtttcttctacaagtgcgttgaaagaatcgcgctggccgccggcagaaagtggagtggtacagccaaacatttcatctacgaaagcacttctgagctgttcggcatttttagtgtaataaagaagactgtgaatatccgtgctacggtcattaaataccgggaacaggaatcccaaatctggcatttctacgatccagtcacggatacggtcttcgatgttgttggtttctgcgttgtagcacaggccggctttggaaagattgaccggacagatgctgcagaggatatggtcatagatttcatcggatgcatcgaacatctcctgaccatcggaagattttccgggaatatcgtaaacggcatgaatgagaatgatatagtaattctcaccataatcataattttcgatgatcttatcataaaattcctcaagtatagcattatcctgaagtttactgccacggagtttcatgagaaattcctgggtaccaccttctttttcctgttcaagcggaaagtccatgttgatcagattttttccaattgtgccggataaagtcttcttgaagatttcaaagtatttaaacatttcttcttccgaaagagaaagaaatgcttctttcagttctgtttttttatttttctcgccatccacataacagccgcagattctggtgatcgcacagttgtttggagaaaactgtttcttaatttctgagatttcttttttgttcattatgtaatgctcctgtttacagaatttctgtacggaatgcttctgcgattccacttaaattgtaacgctctgcaaggtcctgaattcccatcatgatctcctcgcggctgaaattactggcctccagaaattcatcgtctttgccattaaggtggtagtagaacagaagaccaatttcaagattctgacggtcaccatcgcaggtcatttcgtataactgattttctgcctcgtcaattttaccattgtctgccagatctgtaagatttgtaagtatctgtctggcatctgtatcttcaatcacatcaggtgtcagttcgactgcacttacctggaacagcattttcatgactgcacgtaccatttcgcgtatctgacgcagtatataatcatcctgaagcatttatattctcccttccaaattcatgattctgaacaatagagtaccacaaaaaaagagtttcttccagatagaaatctgcacttttttggtcattgttgtgaatattaaactttacgcaatatgcgcagaatgctataataaaaatattaaataagttacgttgtatatcgggtgtaatgggcagcagtggctggtagcgcaggaaggatatgaatgaatgacgaatgatactgcaatgacaaagcaggaatccgaggtaatgatagagcaactcaaaaaagtatttgaagtggttcggttattggatgtggatacactggaaatgggaaatctgaaaggtgtagaagatgtggatggatttccgtgtaaatgctatgatttctggaaaaaaggtacacgttgtaagaactgtacatccagagaagcattacagaaaaaagaaaaagtactgaagctggaatatctgaattccaatatctaccaggtaatttccaaatatatagaaatagacggtaaaccgtatgtgattgaactgatcaatgccatgaagtcagatgcgatcatggatgatgatggacgtacggaactgatcaaacagctttcaggctataatcgggaattatatacagatgcgcttaccggaatctacaacagacgctattacgaagaacgaatcaaaaattctgatatgacagcaggcattgcaatgatcgatctggatgattttaagatatacaacgatacatttggacacgatgcaggtgacctggcactgacgacagttgtaggaatcgtaaaggcgaatatacgtcgtactgatatgctgatccgaatgggtggtgatgaattcctgctcgtgatgccggatattacggatcagatttttgcagataaattaaagcagattcaggaaaaaattcatgatacgaaggttccgggatactcacagcttcgtctgtcggtgagtatcggaggtgtgctttccgttccgggaagtactgtggagaatgcaatccgtaaagcagatcagttcatgtatcaggccaaaacatgcaagaatatggtagtgactgaacatgatgaagaagttcaggacaacgcagagggcggtgaaacatccaaaacctacaaatacagaattctgatcgttgatgattctgagatgaaccgtgcaattctgtcagagatcctcagtgaagaatatgatatcgtggaagctgacagtggtgagtcctgcatcgataaactgagacagtacgagcgggaaatttcgctggttcttctggacatcgtcatgccgggaatggatggattcggagttcttaattatatgaatcgtcatcactaccttgaggatattccggttattatgatttccagtgaggattctactgaagtcgtcagacgtgcatatgaaatgggtgtttcggattacattaatcgaccgtttgatgcaggagttgtgcatcgaagagtctataatacgatcaagctttatgcaaagcagagacgcctgatcactctgatcacgaatcaggtttatgaaaaagaaaagaacaaccgtatgatggttgaaatcttaagtcagatcgtagaatttcgtaatggtgaaagtggaagccatgtactgaacatcaatatactgacaggaatgattctggagagtcttgtacagaaaacagataagtataatatcacatggtcagaaagactgctgatcacaacagcgtctgcattacatgatatcggcaagattggcattgatgataagatcctgaacaagccgggcaaactgactgatgaagaatttaagatcatgcagaatcatacgatcataggagcccgtattcttaaaaatatggaaggatatgaggatgaggaactgatgatggttgcttatcagatctgcagatggcatcatgagagatatgatggcagaggatatccggacgggcttaagggagatgagattccgatttcagcgcaggtagtttctcttgcagatgtgtatgatgcacttgtgggcgaacgagtttataagaaagcatattcccatgagaaagcgattcagatgatcctgaatggagaatgcggtgcgtttaatccgattctgcttgaatgtctgctcgatattcaggacaggatcaaacgcaaagtaaaaggcagtacacaggaaaacaaccctctgaagaagaaagagaaatcagcagaactcaaagagtttgaaaatgcaaaagaagattttatggattctgttttcaaaaatatggaaaaagaatatacggaccttggaaatccggaaaatgccgatttttccaggggggggggcaaagccaaaatgctgatgaatgatatgagaaaaaagttttttgaataggagataaatgatatgacagtcagagaatgttatgaagaattaggatctgattttgataaagtactgagcagactggtgagtgaagcgcttgtaaagaaatttgcgcttaagtttctggatgatccgagttttggacagttggagacagcactggcagataaagatgcagagacagcatttcgtgcagcacatacactgaaaggtatttgcctgaaccttggatttgataatctttttgcaccaagtcaggaactgacagaaaaacttcgtggagcgaccacgatagaaggtacggatgaactgtttgcagcagtagaaaaagaatatgacagaacatgtgaggcacttcgaaagattgcctgacagatttgaaagaaagaatttaagataaaatcccctgtactttgtttttgcaacagagtgcagggtgtttttttccacttgtggagcagtacgatgaaaacaattgcaattgcttcaggaagtccatgtgtactgcttgcagggacatctttcagacagtagatgacaagaagtccgattgccgcatacggaagtacggttccgagatatttgataaattccggtggatttttaccttccgggaaaataatgaatgggataaaacgcgttgccattgttccaaggacaactgccgcaatggtgatgatcgcctgtgttgttgtcatagtcattttgcagccacctccggtttcttactgaatctgcgctcggctgtgaaggccacgatgataaagatcatggacggaacaataaaattgctgcttccgaagatcagaagacagatggcagaacaaattaatcctaccagagctggaagatgatctttggattcttcccattggttcaggaacataacgacaaacagtgcggtcatgacaaattcgattccggttgtatcaaaatgaatcacatatcctaagagtgcacccgctgtagcagcgaatacccagtaaatctggtttaacaggttgacaaaaaacataaaccatccacggtctacatcatctggcagtgttactgtacagttgacagtaaaagattcatcacacatgccaaagatcaggtagaacttcttccaaccggtatttttatatttatccagcatggaaaggccataaaataaatgtctggcattgaccatcagtgccagaaagaaagctgcaaccggactgaatgccgacagcaaaagatttgccgttacgaattccatagatcccgcaaagataaacatactcataaagaatggataccatacagaaaagcccttactctgcatcataaatccataggacattcccaggaaaagaaagcctataccgataggaatcgtgtatggaaacgcggctttgaatgcttttttcttcatttgtgaaaaattccttgacttttagaatgaatatgtatatattttatatataaaatttttatatataattattttacatattatttatggaggtgatcggatgtattatcccgtatcagcattacttatagagtttttgatcctgtccgtagtagaatcacaggattcctacggatatgagatcagccagaccgtcaagatcgtggctgatatcaaagaatccactctatatcccatcctgaagaaactcgagaaaaacggttatctcacaacctattctcaggaatttcagggacgtaaacgcaagtattattctatcaccgattccggtaaagaacaactggtgtatctcaataaagaatggatttcctacagagatacaattgacggaatcattgaagggaggatccgaaattgaccagagaagaatatatgactaaattgcagaaatatcttcgcaaacttccgaagcaggattatgaagacgcaattgagtatttcaatgaatattttagtgatacagatgaggaaggtcagcagagactgatggaggagcttggaactccgaaggaagcggctgcggacctgatgtataaccttctggatcggaagattcaggaacaggatgagagtggtgaagagaaaaagagtaaaaaaggaatcacgctgctggctgttttagctatcatgtcaacacctgtgacagttccactttttatcgcaatgcttgcagtgcttctggcggcagcaatctgtgttgtctgtgtgatcttcagtgactttattgcagcattcagtattttactggtgggtggcaagctgttgctcagaggacttgtttccttcccgtattctttatcgggtgcactgatgatcacaggatgtgggttacttggaattggatgcgcaatcctgctgtatcttcttggaatctatctctgcaaatggaatggtatgcttcttgttatgcttgcacggaaaatagctggaaagaggggtaagaatcatgaaaaaaacaaataaacgtttgctggttgctggtggtatcctctgcgcaataggagtcctgtttttgggagttggtgttgcatccggtggtaaaaattatgtaaaaacagcggatctgaacagaatcagtggaaacgcaatgatggattccagtgacagccatgtgattttaagcaagacaaagatcaattcattttcttctgtgaatgttgatcttcgaaatcttgatctggatgtaaaagaatctgacgatgaaaacttttacattgcatacaatattgagacaaataaaggaatgctgcctctttcctatcaggtacaggatgatactctgaatcttgtagagaaaaagggaaatgagtcatattcatatattcatatcgatatcaatttccttcaggaaatgctcggtcagagccatgtgatcgaaaattcaaataaagtaactgtttatattccgaaggaaaacgacatgagtagtttttcctgcaagatgggatatggtgacttagatattgaatcattgaatgccaaacaggcagtgattcagaatgacgatggcgatgttaaaattgtgagaggtagatttaagaatcttgagttgaaagatgatctcggtgatctgaagattaaagatgttatatttgccaatagtcagattgaaatggctgatggtgatatacaagccgagaatgttacatttaccggcaagaatgagattcgcagcagccttggtgatattgcactcagtattccggaaaaaacacttgcagatctttctgtagaggcagaagcaagtgagatcaatattccggagaaacttggcaaagtcatgacggatgaagacgatgaacagagcgttgattctggaaataaggcacagaattccctcgaaattaagagtgaggatggggatataacgatcaaagctgcgaaataattttgtacaaattgttattgaaaaaagagaacttgtagcatataaaatgagccgctgcattcgcagcggctcattttatctttatctacagtactttattcagaaaatcgatagttcgaggttcttttggattcagaagtacttcctgtggagtaccttcttctacgatgtaaccaccgtccatgaaaagaacacggtcagcaacttctcgtgcaaatcccatttcatgagttacaataaccattgtcataccatcagctgcaagctgtttcataacctgcagaacttcaccgaccatttcgggatcgagggcactggtaggctcatcaaaaagcataatatcaggtgtcatacagagtgcacgtgcaattgctacacgctgcttctgaccacccgaaagctgttccggataagcttctgctttatcatccatgccgaccttcttcagcatgtggatggcgcgttccttagcttcctccttggttgcttttttcagctcaacgggtgcaagcataagattctgtgtgacgttcatatgcggaaaaaggttaaaatgctggaaaaccatgcctacattttcgcgtactttgttgatatcaacatgtttatctgtaagatttttgccgtctacgataacttcaccgtctgtgatttcttccagtttgttcatacaacggagaaaagtagactttccgcttccggaaggtccgatgataacgaccacttcgccttcgtgaatgtcggtggagatatcttttaatacttccagggtaccgaagcttttctttaaatgtgatacgtgaattttgacattctctttatttacggccacggttcagtctcctttctacgattttggctacttttgataagattgtgattatgatcaggtacataactgcgacaataccccatgtctggaacgacataaaggaattggcaacaacgttctttgcggtattgaccagttccgggaaaccgataacagaaagaatagaggtatctttcagtgtgatgatgaactggttgatgatacttggaatcatggtgcggatcgcctgtggaagtacaacacggatcatggcacgtgaatatggaagaccaaggcttcttgcggcttccatctgtccgggatcaacagacaggatacctgcacggatgatctctgccatataagcaccacagttaagggcgaggcagacagtaccggcctggagtgctgtaagtgtgaaattaaatcccatcatattgttcaggcagtacggaacaccgaaataaataaaatatgccagaacgatcattgggacaccgcggattacgtcaacaaaaatagaggatatgatcctgcatgctttgtttttcagtacacttaagagaccaaaaaacatacccagtatacaggcaaagaacagaccacacagtgcaagcagtaaggtctgtcccatagcaagaagcagcaggtttccatatctggttataatctggatcatggaaatctcctttcaaaaacaaagctgccacaaaatgcagcagccctgtaattcgtgtagtgttttatctcagtcagagttttgaatgtaatctggttagaactgagtcttaaaattattcagcagcttcttcatcagcagcaggggtttctgttgcatcagtctctgcttcttcagttggaacggcatcttcaccaaggtattgggcgatgatcttgttatattcgccgctgtctttgatgtctttcagaccagcgttgaacatatcgagaagttcctggttgtcagcgtcgaaaatagcgaatccgtaaggagatccttcatttgcagtgtcttccaggatctggagtgcaaggtccccatctttgatagaggatgccatgatcggtgtatcttcgaagcatgcaactacctgtccgccgagaacagcctgatacattgtcggtgaatcttcataataggtgatgttgaatccgtattcatctttcaggctttctgcataggtagcaccctgagtaccagtcttaacaccaacagtcttgcctttcaggtcatcgaatcctttgatatcggaatctttctgtacagtcatagactgtgtagcattataatatccgtcagagaacagccagccgctgtcttttctttcatctgtaatagaagcaccggcaatcataccgtcagcctgtccagcctggcaagctgcgatggaagcgtcccatccaaggctcttcagttcatattcaaatccctggtctttcgcgatagcatcaagtacatctacatcaattcctacgaagttgccatcatcatcagtatattcaaatggtttgaagacggtatcggtagcgataacccattttttatcagatgcagaatcagcatcagaagctgcaaatacaggaacagtaagacttcctacaagtaatcccatagttaataaataacacatctttttcatgattaaagcactccttttttgtttaatatcgaaaaaaggcgcagtttccaaaaaaactgacgccttcgccgcttttttcaattttatcattgtaaaaatacactgtcaatggaaaattttaactttttaccatattaaaggaattgtcctatagaaagtagaaacgctaattgttgaaaaatctggcaatgtatgtaaaatagtgaatagcatgaaagaaaatatcgtttcagagggaaatataaaaggagtaacgtgatggaaaaaataaagattgctgccatacagatgccgacagtagcagataaaatggaaaatgtaagaactgttaaagcttatctcgaaaaaataaaggatgaaaagccggattttgtgattcttccagaaatgttctgttgtccatatcagacagagaattttccgatttatgcggaagaagaaggtggcccgatatggcagcagttatctgcatacgcaaaacagtatggagtttatctgattgggggctccatgccggagaaagatgcagaaggaaatgtttacaatacatgctatgtttttgaccgtgaaggaaaacagatcgggaaacatagaaaagtacatttatttgacattgatgtcaaaggtggtcagacattcaaagaatccgatacgttaacagcaggtgatagtgatacggtatttgatacggaatttggtaaaatgggagttatgctctgttttgatattcgttttccagaattatcgcgtatgatggtaaatgatggtgcgagaattgtttttgttccggctgcattcaacatgacaacgggaccggcacactgggaattgtctttcagaactcgggcactggataatcagatttatatggttggttgtgctccggcacgtgatgtatcggcaggttatatttcctggggacattctattgtcacagatccgtggggtagagtgacaggcatgctggatgaaaacgaaggaattcttctggctgagttggatatggactatgaagagcaggtaagagaagaactcccattattaaagagcagacgtaaggatatatatcagttagcgaagaatctcatcaatagtggaaacagtactgaaagttcccctgttctttgaattttttgttcaatagtcatcatctcctgagttgttttattttgtaatagacattaacagacaggagaagagatgtccattgacctgaaggagaaaaagagaagaaaatttcttcatttgttgacatattttttaacgagtgatacaatacagttctttgatgaaacaaaatgtaacatgaatgaatcgaaatgcaacggggtgtaacaaacagattatgaacaagaaagaaaatcattctgcgaaaagtgagatagagcaggcatttctgcggcttatgacacaaaaatcctacatggacattacagtaacagatattgtgcaggaagcaaacgttgcaagagtttctttttacagaaattttgcatcgatttcggaagtactggacagtattgcagacgcaacagcggagaagctgaatatagagtttcttccattattagatacatctgatgaacgaaaactgcgggaatatctgttcaattatttttatcagatatcgttgaattataaagaaatgtgggcgattcgcgggttgaatatggatctttttacgaaaagactcggggagaaaattcatgaaaagagaaaagcagtcgaatccgcagattctgatatatcagaaaaatatggatgggttgtaaaactctgtgtactggacggtgtttcgagacgctggatcatggacgaaatgaaagaaacaccggaagaaatcattgattatgtgatgccaatcattaaaacattataaaaacagaatacaaaggaagaagttattatgaagaaaacaggaatcatgacagacagtcatagcgggattttaaacgaagaggccgaaagacttggaatcaaagtgcttccaatgccattttatatcgaagaaaaggtatatcgtgaaggtgtagatttatccagagaagaattttatgatatgctgcgcaagggaacggatgtatctacatcgcagccgtcactggtagacgttgcggagatgtggaaagaaatgttgaaagaatatgaagaaatcgtatatattccgctcagcagtgcattaagcggttcttgtatggcagcaatggcaatggcaaatgaagatgaatttgccggaaaagtctttgtagttgacaatggtcgtgtagcgactccgatgcaccgttcggttcttgatgcagtagaaatgacagaaaaaggttacagtgcagctgaaatcaagaaaatcctcgaggaaaccagagaaaagatgacgatttacattggactcagcaccctggaatatctgaaaaaaggtggaagagtcagctcagtgacagctctggcagcagatgtcctgaatattaaaccagtcatgcatttcagtacaggaacacttgatacttatcagaaatgccgtggtatgaagaaagcacgcaaggttatgatcgatgcgatgaaacatgaactggaaactaatttccgtgaagaatacgaggcaggaaatgtatatctgatggcggcttccagcagcactgatgaagtaacggcagaatggatggctcagattaaagaaagctttccgggaatggatgttatgtgtgataaactttcctttggtctgtcctgtcatatcggtccggatgggctgggaatcggctgtacctgcaaacctgtagaataaacgaaacatatggaaaaatcgttgtgaaaagtcgcagtaaatatttaatacattaatgcggtgcaaatttacagcgattttttattgattgctgtcatcttaaaaccatgatattatcaaagaagctgaaattatttatgaaggtttgagcaaaatatatggatgggggaaagggtaattttatggagaaacatcatcatgaaagaagtacgttttccgggaaactgggatttgtattgtcggctgccggagcatcggttggcctgggaaatatctggaggtttccatatctggcagccaagtatggcggaggaatttttctgctgatctatattattctggcaatgacatttggatattccatgatcatagcagaaacagcacttgggcgtatgacgaagaaaagtccggtaggtgcgttcggcaaatttggcaaatcaaaatggctttcttttgggggctggatcaatgcgatcatcccgattctgatcgtgccgtattattccgttatcggcggatgggtaatcaaatatctggttgaatatgtaaaaggaaatactcagaatctggcaacggatggttatttctcagaatttatttcaaatggagtatccacagagatctgcttcctggtatttgcattatttacagtagggatcatctatgcaggtgttcgaaatggcgtagagcgtgtgtctaaatttatgatgccggttctggtatttttatcaatcgtgatcacggtttattctgtgacaagacctggagctctggagggcgttaagtactttctgattccaaatccgaagaatttttcatggatgacagtagtagctgcaatgggacagatgttctattcactttctattgcaatgggtattctggtgacatttggttcctacatgaagaaagacgtgtctattgaaagttcaacaactaatgtagagatctttgatactgcaattgcaattatggcaggcttgatgatcatcccggcagtatttgcattttctggcggagatccaaatactctgcaggctggtccggcgctgatgttcatcacgatcccgaaggtctttgcaagtatgggacttggaacaccgattggtattctgttttttgtattggtgctctgtgcggcactgacaagctccattgccctgacagaaagtgcagtatctaccttccaggatgaactgaaatggtgcagacagaaatccacactggttgttggtgcgatcatgatcgtccttggcagcctgtcatcccttggctatggaccactggcatgtgtgaagatcatcggaatgcagttccttgatttctttgacttcctgactaactccgtgatgatgccgatcgcagcaattgctacatgtcttctgatctccagagtgatcggactgaagaagatagaagacgaagttgttctcggtgaaggaacctttaaaagaaagaaaatcttcaattttatgatcaaatatctttgcccaatctttgcagcgatcattctgctcagctctgtggcaaacgcatttggatggatttccatgtaataaagaaataataaaaccgcggtattctgtatataaaaaatacaggaagctgcggtttttatgtgctaaaaaagtgcacaggtctggcatcgaatcagactttaggctgatagtgcatatcagatacattataaactgtgatgaaggcgagaggatcctcatggttgatgaaattcattagcttctgatattctgttttatctacgatcgtgatgatctcgtttcgtttctgcatattataggccccgtatgcttcataaacagtggcaccgctgtgcagttcatgaatgatgaagttacgaagttcttcttcttttttggtaatgatacatacacgccgtttgatattgtggtcaaaaataaaatgatccagtacgataccattgaagtatgtaccaagaatacttaaaacaacagttttcttgtcatagaccagagcagcggaaagtgcaacacacataccggaaagggacatggcctttccaagttccatatgcaggtatttattcatgatctttgcgacaatatccagtccaccggaagaggcattccggttaaagagaatgctcagacctacactgacgaccagaatatagcagagaacatccagttcctgactgttggtcatagattcgaaattcgggaagattttttcaaataaaccaagaaaaacaggaagcatgatactggtatatacggtttttacaccaaattcccgaccgcaggtaagaaagccgataatcagaagtatgacattcaaaatcatcgtgatcgcagacagcggaagtgggatgaagttggacagtacgattccaagaccggagatactgctgacagaggtatggcttggtaccaggaaaaaatataccgcagcagcaatgatcgcgacagcaacggtcagtatgactgtttccataaagatttttgcgtaattcagttgtgttttcataaaagaaaatcctttttcatttttaaagtgttatttaattctgagcttccggatttggaagatttaccatgagcggtgcgtgttcaagttcaggaatgatcttgtttttgaggtcttcagtcgtgaatttgagacttgaagtattgatacaaggatgacatccgaagtaaggatttttcatgacatcttcatcaatcagcagctgtactttcttatcatgatcgttcatcagtcccatcacactgacagatcccggagtgatgtccaaatatttttccatatattccggtttagcgaaggacaggcgggcagagttgatctgtgctgacagatccttggtcttaaatggcttgtcacctggcatcagaagaaggtaaaagtttgtctcctgccggttgcagagaaaaagatttttacatatagtagtgttatcgcccagaatacggtcaacttcttcgcaggcttccatagtcatagttgcttcatggtctacacgctggtaagttatgccaagtttatccaacagatcatagacacgaatttctttatcaagtcttcctgatgtggtttcaggtcttccattctgtaattccatttttgtgactccttttttatttcatatctgtgagtgtaccccttttatatggagattgtcaatgagatgtggctttgtgatcattaaaaaaagtctttgcaaaccacataaaatgcagacaatccagccgaataacttcagtgctcttacaaaagatttcaaagtggtgctgccagaagaattcctttatgaaaaagaataaatagaggttggttgcaatattctctccttatgctataatgattcaaaattgaactattcaaaaaagaattaaataaaggagagaaaaaacatgcagattttatggacggtgatcgtcacattttttgcaggaatgggagcagggcttggaacgggctttgcaggtatgagtgctgcagctgtgatcagtcccatgctcatcacatttcttgggatggatccttatatggcggtaggtattgctttgtcatcggatgtactggcaagtgcggtatccgcgtatgtatatggaaagaataagaatctggatattaagaacggtgtgatcatgatgatcagtgtactgacctttaccgtagttggaagttacgtatcgagtcttgtaccgtcagccacgatggggaacttttcagtattcatgaccttccttcttggaatcaaatttattgtaagaccggtcatgacaacgaaagagagcatgcagaatgtatcagcaaagaaacgtgtaattcagtcaatcgtgtgtggagttctgattggatttatctgtggatttatcggagccggtggtggaatgatgatgttgctgattttgacatctgtgcttggatatgagctgaaaacagctgtaggaaccagtgtgtttatcatggctttcacggcatttaccggagcggcatctcattttgcgatcggtggaatgccagatgtgaccgtatggattctctgtatcgtatttacctttatctgggcaaggattgctgctgtatttgcaaataaggcatcaacgaaaacgctcaaccgcgcgactggcatcatactggtcgtacttggaattgtagtgatgttattttctttattgtcataaaaaattactttataaagtaaaagtatcagtagaacgcaaaaggagaagccattttcaggcttctccttttagtatgttgtcaagattctgatccataatattcagaatctcgagaaatttctgtcgcgtttcgttatcaaggccggtcaggatccggtcaataaaatcctgctgaagctgtcggccctttgcaatgattggttgagctttttctgtacagagcagttcggtcttacggcggtcactttcgatcgcatgacgttccagatatccgtcacagacaagcttgtctacattgacggaaactaggtttgcctttaatttacggacttcgacaatatcccgtgcagtgcagaattcgggattatttgctagaaacataagaatgtcgaatgccgtctgcggcaatttcagttcctgacaaagcgatttacaggttctgttatatgcaagagaagtttttcttgcgaattcaatgtttatatccataaaaaatcctcgattatagaaagtataaatatgatagttcaaattgcaattaatggtgaatttatgggcagcatgagtgcgatcgtgctgccttttttgctgctcgccagaacttttacctggccgccatgttgtctggcaatctcggctaccagggcaaggccaagaccggccccacccatggcgcggctgcgggatttgtctacgcggaaaaacggggcgaagattttttcctgatattcaggtgagataccgattccagtgtctgttacttcgactaaagcatagtctgctggtttggaatgcgcagcaggcagatcttttttctgagatatttttaccgttacttttccaccagaatgattgtatttgatggcattttccacaagattataaacagcacggtagagaagaagatagcttccggtaacggtgcagtcaccctcttcctggatcagttccacttttttctggtcagcaatggcggcaagatcgcagcagacttcatcggtgagttctgccagtgaaatagaatcagagcgttcaacggattgtatcccggtcatatcgagaaggacctcagatagatgagaaagtcgttcggtctgattctggatcattccaaagatgtcctgatattcttctattgtcggagttttcttgcgtgcaaaaacttcgaggtttgtctgcatgacagcaagcggagttctcagctcatgagcggcactggcagaaaactgcttctgtgctgtaaacgcatcatccagtcgggaaagcatcttattaaaagagcctgtaagacgagaaatctcatcgtttgtatctggaacttcaagagactcagaaagattctgggcctctattttattgacttcgttactgagtcttcgcagaggcagcagtgcacggcggctgataaaatatgtaccgacactgctcaggagaataatgattgcagttgcaatgatacttctggtgcggaaaaggtctttggtttcctgtacctgatcggaaagacctgcaaacagagtgtttggattaatgttaaaggtgattggcgtggaatcagtttcattgatctttacgacataatcacccagattttcgattccggtaacagcggagttactaataaaaaaatacatcaagacacaggtgacagtcatcaggagcgtgatgatcagtgtcagcctccactgcagagagagttttttcagaggattttttgttgtatgttcttttttcatttcagatcctccatgagaatgtaaccctgtccaaccttgttctgtatcggatcgtttcccagagctgcgcgcagcttcttgcgaagggaagaaatgtggacacggatggaattactgaagctgtttacactgccgtcccagatatgttcaatcagttcttccgggctgatgatacgattctggtggagcataaaatactccagcagagcactttcctttcgggtgagagagagttcttcactatcaatgtgtgcttttctggtgcgggtgtcaaagctgatgtggccgcacttcaggcagacattctcctgaataaatctgcgcctggtcaggctgcggatacgcgcttccagttcctcaaaatgaaatggttttgtcagataatcgtttgctccaaggtcaagtccttctactttatcctcaatctggccacgggctgagagaatcagaactggtgtggaagaatttgtctcacggaactgccgcaggatatccaatccgtcaatgccaggaaggttcagatccagaaggatcagatcgtagttttcagtcgtacataattccagcccttcgtctccgtctaggcaggtatcggtttcatagccatccatacgcagcccctctgcgatcgaacggcagagctgctcttcgtcttctattattaatatgtgcatattcgttctcctttggggacggtgtttgtggcttttttagtgtccccctttactttcctatatactatcacatcagatataaaattcgtgtaaaaaaataaatcgaaagaattttgattttcgtgttttcttaacacaaattttatagctatggtgttataattgcgactataataaccgagtcagggggacagacaaaaagccgcaaacactgtccccaatcgaaaggagaaaacttatgaaatttacagcacttatggcagcagcaatattaggggtatctacacttggaagtgtatccgtaatggcagcagaaagtacagaagcaatggcggttccggcagatcaggcgggaatggtggttgatggagatgcagctgcagcagatggtgacgcaatcccatctgattttatacagggtacttttaaaccatctgagacaactgtgcaggcacaggattcttatgagtatccattccttggacttacaatgaagcttcctgaagaacttcttaaacagattaaagagcagaccatcgcgatgatcactaatgagggatggaatgacaatgcggatgcaatcaaatatgcatatataagctggagcgaaatgaccgaggagcagaaagaggccgaggttgacaagcttggaacagcatatgatgactggtgcaaaagcctcgcaaaaattggagtgatcggaatctatgatgaagattcagagaaagaactggacgagctcacaggctgtacagaacacaaagaaatcggaagcagcagcgacggaaaatacaaatactatctgagcaccaacaaggatgcagatgaatccttgaaaaaagaagtggaaaaaatcgatgtgacactcacagagatgacaccattccagcagctttctgcgtttgaccagccacaggataccagcaatgcaggcgattccacaacggtaggtaagtttgagacaaaaggtgttgacggaaaagattatacagaaaaagtattcagtgactatgatctgactctggtaaatatctttactacctggtgttctccatgtgtcaatgagattccggaactggaaaaactctatgaagagatgaaagaaaaaggtgttggcgttgtcggtgttgttcttgatacagtaggagatgatggcaaacaggatgatgctgcagtgaaaaaagccggtgtccttcaggagaaaacaaaagcatcctatcctttcctgattccggattcaacaatgatgaatggacgtctgaatggcatctctgctttccctgaaacattctttgttgacaaagaaggaaacattgtaggagaaacatattccggaagccatagcctggacgagtggaaagaaattgtagaaaaagaacttgcgaatgtttcaaaataacagagttaaacagtagaaatgccagattctagaagaaagataaatatgattatgataaaaaaaattacagaaacaaaatggacaggagttgttttggcaattattggaatccttctgatagtttttggaatctacagaggtgagatgtccgtggtttttacaaaagcaattaatatctgtatggagtgtattggaattggataagaaaaaattaaagataaatgagtggccacggcatggaatccaggcattgtgggcactgctgacaaacagccatctgtccggatttgtgaccggtaagatctataccggaaaattaaaaaatgtctgtgttcctggactgaactgttattcctgtccaggagcgacaggagcttgcccgatcggctctcttcaggcagtggtcggaagctggaactttaaaatggcatattatgtagtgggctttctgatctttgtcggggcattgcttggcagactggtctgcggatttctttgtccatttggcctgattcaggatttgttgaataaaattccgtttccaaagaagatccggacgtttcgtggagataaactgcttcgtaaattgaaatatgtcatttttatagtatttgtaattcttctgccaatgtttgtggtagatatcatgggacagggagcaccgtatttctgcaaactgatctgtccggcaggaacgctggagggcggtcttcctctggttctgctgaataaatccatgcgaagtgcagtgggatggctttacctctggaaaaatgtgattttggtaatcacgattcttcttgctattatgatatatcgaccattttgcaaatatatctgcccgctgggagctttttattcgatatttaataaagtatctgtatttcgctatcgtatagatcaggagaaatgcgtccactgtggaaaatgtgcaaaagcctgccagatggaagttaaccctgtggaaaaccccaacagtgcagaatgtatccggtgtgggcgatgcaagaaaatatgcccgacacaggcaattcagtgtggagtaaaaaggaactaaaatctttataaaatcttaatatcatatctgataatcttataccatctttgaactctggcatatataataaaatgcaaagttaatgatagtaaaatcatcaaaaaggagcagaaattatttatgccggagcatttacataaaagaaaacatctgacatcatttcaactaattattttaggctttgcgggggtgatccttataggagccctcattttaactttacctgtttcatctgcaagtggagttgtaacgccgtttgatcaggcactttttacatcaacttcagcggtatgtgtgacaggacttgttgtgcaggatacaggcagttactggtctgtttttggacaggcagttattctggcacttatacagattggaggtttgggagtagtaaccgttgcagtatcagtatttatgctgtcaggacgaaaaatatcgctcatgcagcgtagtacgatgcaggatgctatttcggcaccaaaagtaggaggtattgtccggctgacaaaatttattctgagaggcacctttctgatagaagcgcttggagcagtattattgcttccggtattttgtcgtgattttggaataaaaggaatctggatgtcagtttttcactctatctcagccttttgtaatgcaggatttgatatacttggtacaacagaccatacttttgtatcgctgaccggatacagcagaaatatctggctgaatatagttattatgcttttgatcataactggtggtatcggattccttacatgggaagatttttatataaataaatttaaatttaaacgttaccgcatgcagagtaaaatcattttaatgactacagcgatactgatttgtttgccggcgattttcttttttaccaatgattttaaaatgttttcaggagaagagcgaactttactttcattttttcagtcaataacgacgagaacagccggttttaatacggcagatatggcattgatgacagagtcggggaaagcagttatgatctttcttatgttgataggaggatcgccaagttcgactgccggaggtatgaagacaacaacatttgctgttttgatattaaatgcgtttgcaacatttcgaaaccgtgaagacgcaggcgcttttggacgaagatttgatgggcaggtaataaagaatgcggctactatagcgatgctgtattttatgctgcttttctttggggggataacgatcagtgtttatgaaggcctgccggtactgacttgtttttatgaagcagcttctgcagtaggaacagtaggacttacattaggagttacaccgggacttcacataatatcacgtttgatattgatcgcacttatgtatttaggtcgagtaggaggaatgacattaatatacgcggtattttccggaaagaacaataatggtgcaagaatgccattagaaaaaataacagttggataaaaggagtaaaaaaaatgaaaaatattttacttattggtctgggacgttttgggaaacatattgcaatgcagctaaaccagatggggcatgagattatggcagtggatattaatgaggaacgggtaaataaagtccttccttttgttacgaatgctcaaattggagacagcacggatgctcaatttttggaatctcttggaatagggaattttgatatttgttttgttacgattggtgaaagctttcagaattcacttgagacaacatcgctattaaaagaactgggagcaaaactggtaatctccagagctgagcgagatgtacaggaaaaatttctgttacgtaatggtgcagacaaagtggtttatcctgaaaaacaagtggcaaaatgggcatctatccgttatacagacgatcatattcttgattatatggaagtagatgcttctcatgcaatatttgaagttgaagttccccgtgagtggattggaaaaacagtaggaggacttgatatcagaagaaaatatgatataaatattcttgcagtaaagaatgagggagaagtcagtatagcggtatcgccgaatacggttcttattgccgggagtacgattctcgtgctgggagattataaggcaattcaaaaatgctttcatatctagggacaagaggtgataaatgaatggcaaagacagttctggtattgatcgtacttgtgatgttcagtatagggctttttatagtatctaaagttggtgtttttcttaaagagagtaaaaaagaagcttctgatgaaagagaaggagtacaattagtaaaaatactggaaggaataccaggtgaaagaacaaaagtgaatatgaatattcaagatagtgcgtggacaaaaagacagaaaaatcatcatcccatatatattgaaaaaccatcgataaaagattatttgttgacattttcaatatttgtaggttgtacggtgatcggtctggtttttcagaaacttcatttcacagatatcaatattgttacagtgtatattcttggcgtgctggtcacatctattgtaacggatggttatctctgcggtctggtgggatcgtttttaagtgttgttcttttttgtttttttcttacggagccacgaatgtcctttcaaacatatgcagttggctatccggtgacatttttaataatgttgatatcttcagtgcttaccggaactcttgctgccaaattaaaagatcatgcccggttatctgagcaacaggcatttcgtacacagatcttatttgatacggacagattacttcaacaggcgaaaaacagtgaagagattctttgtgttacctgtaagcagctggtacgtttgttgaatcgagatattgttgcatatattgtgaaaaataatgatttatcagaaggaaagatgttttttaataatactaataaaagaaatggagaatatctgacatctgaagaacagtgtgttgcaagatgggcatatgagaatggacagcgcgctggagtaacaacaactcattttagcagtgcaaaatgtttgtatctttcaatccgtagtggagaaagtgtctacggagtgattggaataccagttaaaaaagatgcaatggattcttttgaatatagcattttactttctgtgatcaatgaatgtgcgcttgcaatggaaaattcacaaaatgcaatagaaaaagaaaaaaatgctattctggcgaaaaacgaacagctgcgggcagaccttttgcgagcaatttctcatgatctgagaactccgctttgctctatttcaggaaatgctgatatgttgctgaataatgagagatgtttggatgatacaacaaaacaacagatatatacagatatttatgatgatgcagaatggcttattggtgttgtagaaaatctgttatctgtcacaagattaaatgatggaagattgaaaataaaattcacagatcagcttctcgatgaagttattgcagaatccctgcgacatatcagccgaaagcatgatgcttataagattcaggtggaatgtgaagaactgattctcgcacatatggatgttcgacttatcattcaggttcttgttaatttgatagataatgcgataaaatatacaccgcaaggttcaaccatatgtattcgcggattaagaacagatggcagagcgcaaataagtgtagaagataatggaccggggattgcggatgaaatgaaatcgcatatatttgagatgttttataccggaaaaactacgattgctgacagtcatcgtagtttggggctgggccttgcattatgccattcgattattgaagcacatgaaggggaattaacacttaaggataattatcctcatggctgtatttttgtttttacattaccgttaagtgaggtaacactaaatgaataaaacatcaattcttattgtagaagacgatcgtcctatacgaaatctgatcgtaacaacattaaaaacacatgagtacaaatatcttacagcagaaaatgggagagaagcgattttggaagcatcttcacacaatccggatatcattttacttgatctggggcttccggatatggaaggagtagatgtgataaaaaaaattcgtacctggtccaatatgccgattattgttatcagtgccagaagtgaggattctgataagattgaggctcttgacgcaggtgcggatgattatattacaaaacctttttcagttgaagaattgcttgcacgtatacgtgttacacagagacggcttgcggttattcagactggtgagatacagaagacggctgtttttattaatggagaactgaaaattgattatactgccggctgtacttatatgagaggggaggagttacatctcacacctattgaatacaaacttctttgcttattatctcgcaatgtaggtaaggtgttaacacatacttatattacacaacagatatggggaaggtcttcagaaaatgatgttgcatctcttagagttttcatggcaactttgcgtaaaaaacttgaatcagataagaatgaaattcaatatattcagacacacattgggattgggtatcgaatgctgcggatagagtaagtaacctttgattatttaagatatagataggtaaatacagaattatctgatataatgaagctacttgtattgaaaatgaaagaggaggaataagcaatgatttgtggaatgacatattttcagatatgtctgtatttcctggtctattcttttggaggatgggtagttgaagttatttttcatgcagttgcgcttggaaaagtaataaacagaggatttctgaacggaccggtctgcccggtatatggctttggtgtgctctctgtttttgccctgcttaatacgattcaaagtggtggacatcagatgagtgaaggaatgatctttgtatttggatttgttcttgctacagcggttgagttgatcgcaggatggctgcttgatgtgtgtttccatgcaagatggtgggattattcagataaaccgttgaattttcatggatatatctgcctggagttctctctgatctggggccttgcaatcgttatggtagtaaaggtttttcagaaatatgtagaaaatcaggcgtctcatacaccggcaacctgggagtgggttgtgatagcaatcttatatgcagtgtatctgacagactttattgtaacagtagcagttatccgtggattgaataagaaacttaccagattggataaagtcagctcagatctgagaattgtgagtgataagcttagtgatacactggcaacgactacgattgatacagcgcagaaggttggcgaaagaaaggttcaggcagcacttgcaaaagctgaactgcttgagacgacagctgcccagaaagaaaaaactgttgaaatgctccgtatgaaaaaagcagaacttcaggcacagtttgacgagttatccagttccatcacaaatcatactgtattcggtcagggacgacttcttaaagctttccctgagatgaaacacagagattactttgagctgattcaggaattgaagaaaaaactgaaataaaataaaaacagttttatgataagaaaacgaaacaacatagttgtattatagaaagattaacaggcactcgccctatctctccataactctccataagtgatacccgtattaccttttggggatttcaactttccctaactcggtctatcacaccatatcacgccgtaagtttagtattacgatagtataaagaaaagccttaaccatttgtttcgtggtcaaggcttttgtttttactgtatttcttctatttcgccagtatctttgttcacatgatattctttgagaagtttaccactgaaaagcagttttgcatcatgttcttctttgtcaacatattcatattcagaaaaaagcagaacccggcagtaatgcagagttctgttttttgttacagcgaaagagagagcttgacaatttctccaactcctatataattaacaatggtaattatcaaagataactatataggagctttttatgacaaacgaaaaagttaagagaatgcttgatgcatgttatcaggcaaaacgaatacgggaattacttcctccacttccgcagggagtcatgccgtcttatattcagtatatggatacgatccagaaactggaaaagcagggagttcaggtaaagatttcggatatcagtgatgcaatgaatctgccgcgcccgggtgtgaccagaacagtaaaagagatggaagcgaagggctatcttcataagtttgcatctaaggaggatggacgtgtcacatacatatccatcaccgaagaaggaaaaaagctgtcccggaaatatgatcaggattatttcagtgaactggcttgttctcttggtgacatttctgaggaagatgcggattgtatgatccggactattgagaaattctatcagatcatgtgtgagaggaggaaggagtatgacaaatgatagggcagattttacccagggaagcatcctgaaaaaactggttgcatttatgatgccggttcttggagccttgatcctgcaggctgcgtatggtgcagttgacctcctggtcgtaggtagatttggttccacatcagggctttcagcagtttccaccggaagccaggtgctgaacctggtaacctttgtagtagttcagtttgcaatgggaattacggtcctgatcgcccgttatcttggtgaaaaaagaccggaaaaaatcggtgccgtcattggcggcggtgttgttgtatttacgatcatttctgtagcattgttttttgtaatggtatgctttgcacatccaatttccgtactgatgcaggcaccggcagaggccgttgacctgacatccagttatgtacggatctgtggaggtggtatcttttttattgtggcatataatctgctgtctgcaatcttccgtggactgggcgacagtaagtcaccattactttttgtactggttgcatgtatcgtgaatgtgatcggagatatggttctggttgcaggcttccatatggatgcagctggtgctgcgattgcaacggttacagcacaggcactcagcgtcgcgtttgccgtgcttctgcttatcaaaaaagaccttccgtttacaatcaaaaagagcgatttcagactaaatccgcagtgtaagagatttcttcagatcggattaccgcttgccctgcaggagtttctgacccagctttccttcctggcactctgtgcctttgtcaaccgacttggtctggaagcctcttctggatatggggtggcctgcaagatcgttaactttgcaatgctcgtaccaagttcactgatgcagtccatggcgtcctttgtatcccaaaatgtaggtgcaggaaagaaaaaacgtgcaaaacagtccatgtttaccggaatcggagtgggactggtggttggatgcctggtatttgtgcttgtgatgtttaaaggggatgtagtcgcaggtattttctcaaccgatgcctcagttatccagaatgcctttgactatctgaaaggttttgcaccggagacaatcgtaactgcaattctgttcagcatgattggttatttcaatggaaataataagaccgtctgggttatgattcagggactggtccagacacttctggttcgattgccgttggcatattatatgagtatccagccaaatgcaagcctgaccaagattggtctggccgcaccggtggcaactgtgacaggaattattttgaatgtgggattctttatttatctgaatcgcaaagagaaagcagttacttctccatcttcttaagttcgggcagtacagtatagagcatggtcacaaagcagatgcttccgccgatcacatttgacacaggttctgccaggaacacgcctttggttcccatgtgcagggcatatggcatcaggtaagtaagcggaactacaatgaataccttgcgaagcagagagaagaagattgcaaatttcttcttattcagagacttaaatacagtctgtccgatatactgcagatccataaaaataaatgcagcgaaatactgttttaatgcaatcactgcatctttcagcaacatggtgtcggagctgaagatccggatcagaaactccgggatcaaaatgatcatgctccatgtaattgcagtatagatcagaaccatgacagacattaccgcaccggctttgcgtacgtgctttggacgacatgcaccataattatagctcagaatcggagaggctccctcgtttatggcatgaagaggtgtttctaccaactgacgtatactggatataatggtcataacagaaatataaatatcgccaccggtgacagacagtacattgttgcagcagatcgttaccaggctgtttgtcagctgcatgataaagccggcagaaccaagacttacgatatctttggcataaccggaacattgtgaaatctcattttttctgagaaagcggacttttaattcggattttctggttaggaaaaacagcacaaaagccgcagataaagtctgagagagtatagtagctattgcagcgccctgtactccaaacccaagaacaaagataaacaaaggatccagcagaaggtttgcaacagctccgatggcaacagaaagcatgccgatggttgaatatccctgggcattgataaagggattcattccaatggagatcatggaaggaatcgttccgatcaggtagaccattatgtaaggatatgcataggtaagtgcattctgagaagcaccgaatacgaccaggatcggacgggcaaacagaaagccgatgagcatcaggaaaacaccgcagatgcagagcatggaaaaagaagtatccatgatctggacggcagtgttttcctgtttttttcctcgatagattgaaaacagcggtgcaccaccggttccaaacagattggagaaggccgtgatgatcacgatgataggaaaacaaagtcccactgcaccaagtgcagcagttcctactttggggattcgtgcgatatagacacggtcaacgatgttatacaataaatttaagatctgggcgaccagcataggaagagtagcacctaaaatatttccggtcacgcttccgttttcaaagtcaattcttttcattttattcatgtcctttaagagttattattgtaactgagtatagcattttattaaatatatgtaaaacgcagtgaagtggtgaatgtagtgaattaagtaatcattgacagcgttttttttacgtgttatgatgaattcgattttgagagacgaagatgcagagtaacagacagagtcttttcaaagcaattgttttggactacccgtcagggttaaggccatacggacagccgggtccactgccgattatggtaactttggttaccttattgattgagttaaaagctcaaattttataagtaggttcctttgataaccgagatgcgcccaaagcgcagacttgtgaaacgatcaataagagtagtaaaagtatgattgctatatagactctgatacgcatgcgaatatagatcaaacgcaggtttgtggcttagtgccatgacttgcgtttttttattttgttcagtctgtggaatgtagattaagggttgatacaaaggaaactggaattggaggaatgatgaaaggaagtcgttttaaattaaaccagaatcatgcaccaatacatgaagctctggagactttccgtcgtatgagggttgtaccatttgatgtacctggccataaacgaggaagaggcaatccggaactgacagaatttctgggacaaaaatgtgtaggtgtcgatgttaacagtatgaagccactggataatctctgccatccggtatcagtaatacgggaggcagaagaactggcagcagatgcttttggagcagcacatgcattcttgatggtaggaggcacgacaagttccgtacagacgatggtcctgactgcctgcaaacgtggagatgagattatactgcctcgtaatgtccacaggagtgttttgaatgcacttgttttatgcggtgcgattcctgtttatgtaaacccggaggtggatcagcggctcggaatttcccttggaatgaaaagggaacaagtggagaaagcaataaaagaacatccaaaggcagttgcagtactggtaaacaatccgacttattatggaatatgcagtgatctgcgtgcaatcgtcaagatggcccatgatgcaggaatgctttgcctggcagatgaggcacatggaacgcatttttattttggaggaggtcttccggtttctgccatggcagcaggtgcagatatggcagctgtgtccatgcataagagtggaggaagtcttacacagtcaagccttcttcttactggtccggacgtacacgcaggatatgtgcgccagatcatcaacttgacacagacgacctcaggaagctatcttcttatgtcaagccttgatatttcaagaagaaaccttgcacagcgcggccgtcagatttttcaccaggtagccgatatggcagaatacgccagagaggaaatcaatgcgatcggcggttattatgcgtttggcaaagaactggtaaacggagattccgtttttgattttgatataacgaaactgagtgtacatacgctggatatcggacttgctggaatcgaagtgtacgatattctgcgtgacgaatatgatattcagatagagtttggagatatcggtaatattcttgcgtatctttccattggagaccgtgcgcaggaagtagagcggcttgtgagcgcgctcgcagagatacgcagacgttttcagacagatggttcaggacttctgagccaggaatatattgatccacaggtagtgaccagcccgcaggatgctttttatgcggacaaatgcagcctgccgcttcgtgaaaccgagggtaaggtctgcagtgaatttgtaatgtgctacccgcctggaattccgattctagcaccgggagaacgtatcacagcagagatcctggattatattgagtatgccaaagcaaagggctgtaatatgacaggaccggaagatccagatattttgagactgaatgttctgacagggagggaatgacaatggaaatgtggttttcagaatttcatacaccggatgtgaaacacagtatccgggtaaaccgccagctttattccagacagagtgagtatcagagaattgatatttttgagacaccggaatttggtcgtgttctgactctggatggaaatgtaatgctgacagagcgtgacgaatttatttatgatgagatgatcacgcatgtgccgatgtcggtccataaagaagcaaaagatattctggtgatcggtgccggagatggcggcgttgtccgtgaactgaccagatatgacagagtacgtcacattgatctggtagaaatggacccgatggttgttgaggcctgtcgtgcctatcttccgggaaatgcctgcagactggatgaccgaagagtacatcttcattatgaaaatgcgctgagatttatccgaaggtgcgaagcaaaatatgatctgatcatcgtggattcttctgacccgtttggtccgtctgaaggattgtttacccgtgaattttatggaaactgttacaatgcactgaaggatgacgggattatggtaaaccagcagggaagcccgttctacgcagaagatgcacatgccatgcagcgcagtcataaaaggattgccagcaccttccagatcagccgtgtttaccaggcacatatcccaacctttgctgcaggttactggctgttcggatttgcaagtaaaaaatatcatccggtggatgacctggatgcagaggcatggaatgcattaaatctccgtacacgttactatacgaccagactccataaaggggcattttatcttccggcttttctggaagacatgctgaaagaagtggaggattaatttatgatcttacctaatatagaaacttttatcggctgcgaaagcagttttgaggaagcatccattgttctttatggtgcgccgtttgattctacaacaagttttcgtccgggtgcccgctttggtccatcagccatgcgccatgagagttttggcctggagacctacagtccgtatcaggataaagaccttatagacatcagcgtatttgacagcggagatctggagctttgctttggaagcagtgaaatagcactttcagacattcaaaagagagcagaagaaattttgaaagcaggaaaattcccactgcttctgggaggagaacatctggtaacattgggagcagtgcgtgccgcagctgcaaaatatccggatcttcatattattcattttgatgctcatgcagatctgagagatgattatctcggagcaaaattaagtcacgcctgtgttcttcgaagatgccatgaaattgtgggagacggccatatccatcagttctgtatccgaagtggagagagagaagaatttcagtttgcttccagacacacagattttcatccgtttacttttgaaggactggaagaaacagtcagagagctgaaagagaaacaggttccggtgtattttacgattgatctggattgtatggacccgtcagtatttccgggaacagggactccggaggcaggcggcgtgagctttttagagcttcttaaagcaatccgcattgtttctcagacgaacgtggtaggagcagatgtcaatgaactggctcctatgctggatgtgagtggtgtttcaactgcaacagcctgcaaggttcttcgtgaactgcttctggcaattgcaaaataatattaatagaaaacagtaatatatcaacataaaaaaggagaaaaattatgagtagagtattagtgatcggctgcggaggagtagccagtgtggcaattcagaaatgctgccaggttgatgaggtattcacagaaatgtgtattgcaagccgtacaaaggaaaaatgtgatgcacttgtagaaaaactgaaaggaaagacaaaaaccgttcttactacagctaaggtggatgcagatgatgtggatcagctgatcgaactgatcaacagctacaaaccagatctggtaatgaacatcgcacttccttatcaggacctgacgatcatggatgcatgtctggcatgtggtgtaaactatatggatacagcaaactatgagccggaagataccgatgatccggagtggcgtgccatctatgaaaaacgctgcaaagaagaaggattttccgcatactttgattattcctggcagtgggcataccgtaaaaaattcgaagatgcaggacttacagcacttcttggatgtggatttgacccgggtgttacacaggcttactgtgcctatgcattaaagcatgaatttgatcagattgataccatcgatatcctggactgcaacggcggtgatcatggatatgcatttgcaacaaactttaacccggagatcaatcttcgtgaagtaagtgcaccgggaagttactgggaaaacggacactgggtagaaatcccgccgatggatatcaagagagaatataactttgaccaggttggagacaaggatatgtatctgctccaccatgaggagattgagtctcttgcaaaaacaatcccgggtgtaaaacgtattcgtttcttcatgacttttggacagagttatctggatcatatgcgttgccttgaagatgtaggaatgctttccacaacaccgattcagtacaatggacaggaaatcgttccgatccagtttttgaaagcactgcttccggatcctgcaagccttggaccacgtacaaaaggaaaaacaaatattggatgtatctttacaggtgtaaaagatggaaaagaaaaaacctactatatctacaatgtatgtgatcatcaggaatgctaccacgaagtaggaagccaggcaatcagctatacaacaggtgttccggcaatgtgcggagcacttatgatgctgaccggaaaatggatcagaccaggtgtgtatactgtagaagaatttgatccagatccgttcctggatgcacttgaccgttatggtctgccacgcagcgaaagccacgatccaaagctggtagactgatggaagggttggataaaagagctccgtttacagccaccggcggaatgatcccgccggaattccagaatctaaaaacaccctgctacatcctagatgaaaaagcactcataaaaaatgcaaaactgctcggtgaagtgtctgagcgaacaggctgtaagatgctcctggcacagaaagcattcagcaattatgactgctatcgtttttttgagccgtatcttgcaggtacggaggccagcggactgtttgaggcacgactcggagcagaggaaatgccgggaaaagaggttcatgtattctgtgcaggctaccgggccgatgattttgaagaacttcttcaatatgcggatcatatcgtgtttaattcaccatcgcagctccttcgttttggtgcaaaggcaaaagtagcaggaaagagcgtcggattgcggatcaatccggaatgttctactcaggaaggacatgatatctatgatccctgtgctccgggaagccgtatgggtacgacaagagcacagtgggatgaagcatttcagaaaaatccggaacttttggatttactcgatggccttcacttccatactctctgcgagcaggattccgatgatctggagacaactcttgtttcagtaaagaagcattttggtgatctcgcttccagagtaaagtggatcaattttggcggcggccaccatatcacaagaccaggttacgatattgaaagactggaacgttgtatccggatggtacaagaggaatggaaggcagaggtttatcttgagcccggagaagcgtgggcattaaatgcaggattcttgctgaccagcgtgttggatgttctgaaaaacggagagacacagattgcaatcgtggatgccagcgcagcctgtcacatgccggatgtactggaaatgccttatcttccgccacttttgggaacagatgagacagaagagggtggaatcactgttcgccttggagggtcgacctgcctgtcaggagatgtgatcggagagtataaattccgacagcttccggaatatggagatcttctgatgtttggagacatggccatctatactacatgtaaaaataacacctttaacggaatgtcattgccgaatatctggctcagacatgctgacaatacgatgcagcagcttacagagtttggttatatggattttaaggaaagacttggaagtcgtgaataacggcttcctttttttatgtcgagagcatatcatcggattaaatatgttgaaatggaatatgtacgtcataaataggaatacatcaatatccccctacagggcttatggatgccagaccgttttggtatcattgagtaagttaagttaccaaataaaaagcgagggaacagataatgaaaaaggggattttaacaattgccggaatgcttctgactgtatcactggtcagcgccggaaccacagtgcctgtactggcagatgaagaaacaacactggtatacggaagcggagattataccagaatcaacccggccatggacgaacatggcgagatcaatattctgatctttaatggattaactgcacatgacggagacaatcaggtagttccgggactggcagaaagctggaaatttgatgatgcaacaaatacctacacattccacatggcagaagatgctaaatggcaggatggcgaacctgttacagcagacgatgttaaatttacgatcgaagctatcatggatccggaaaatggttctgagaatgcaccaaactacgaagacgtagaagagatcaacgtggttgatgaccatacagttgaattcaaactcgaggacaaaaacgttgcatttcttgactatatgacaatggcagttcttcctaagcatctgcttgagggagaggatatgcagacatctgatttcttccgtaacccggttggaactggcccatacaaaattgaatcctgggatgaaggacaggctatcacacttgctaaaaatgatgattacttcaaaggtgagccttctatcgataaaatcgtatttaagatcgtaccagatgacaatgcaaaagctcttcagttaaaatccggagaactggatctggctcttttaactccaaaggatgcagcagcttttgccggagacgatgcttatacatgttatgatatgaagactgctgattatcgtggaatcatgtttaactttggaaacgaatactggcagaaaaaccgtgacctgatcccggcagtatgctacggacttgaccgtcaggcaatcatcgacgcagttatcctgggacagggaatgcctgcttatggtcctcttcagagaaatacctacaactgtgaagatgttgagcactatgattacaatccggaaaaatcaaaagaaatccttgaagctgccggatgtgaaatgggtgatgatggattctactaccgcgacggcgaaaaagtaggttttgtgatcagtgtaagtgccggagaccaggtacgtattgacatggctcagatcgcagcacaggaactgagggaaatcggtatggatgtatctgtagaaatcccggcacagacagactgggcaggacagatggcattcctgatcggatggggaagcccgtttgatgctgacgatcatacatataaagtattcggaacagataagggagcaaactactccagctactctaacgaggaagttgacaaatatctgacagaagcaagacagtccgatgatccggaggttcgtaaagaagcttatgctaatttccagaaagctcttgcagaggatccggcttatgcgatgatctgctatattgatgcaaactatgttgcagacagcaatattaaggggatcgatcctgataccattatgggacatcacggagttggtattttctggaatgttgcagactggactattgaatgaataaaacgagataagggttgtgacgggggcacgcggagtgccccctttttacacgagcggaaaaagggttgaaaatggaacatttattagaggtcaaaaatctttcagtcagcatagatggtccttcgggagaggtccaggcggtaagagatgtctctttttcgttaaaaaagggagaagtgctggctatagttggagaatccggatgcggaaagagtgtactttgcaaaagtatcatgaagcttttgccgccaagggccaagataaaagagggcagtatccatgtaaaggggcaggatattacctgttatcgggaaaaagagatgcagaagcttcgtggaagaattttttccatgatctttcaggatcctatgacttccctgaatccaacgattaaaattggaaaacagattgcggaagcagtgttgatacataataagaactatacaaaagaacaggtaaaccaaaaggttctggagcttatggaactggttggtatttcgcatccaaaggaacgttatcatcagtatccgtggcagttctccggcggaatgcgtcagagatgcgttatggcgattgctctggcagcagatccggatattttattcgccgatgagccgaccacggcactggatgtgaccattcaggcacagattctggatcttctgcgcgaaatccagatgaagtttggaacagccaccatactggtatcccatgatctgggagtagttgcccgtgttgcggacagggtagcggtaatgtatgctggcaagatcgtggagattggcacagcggaggaagtctattatgatccgcagcatccatatacctggggcctgatgagatcacttccggcatttgcaaaaggaaaagaaagcctgtacacgattcctggaatgccgcctacattgatcaatccacctaaaggggatgcttttgcatgtcgaaatgaatatgcgctgaacattgattatgaagaaatgccgcctatgtttaagatcacagacacgcattatgcggcaacctggctgttggacccaagggcaccacagatcaaatcacctatgggaggacagtgcagtgagtaaagaagtattattagatgtcaggcatctgagccagcagtttcatctgacgaaaaagatcaaagtaaaggctgtggatgatgtctctttccagattcataaaggtgagatctttgggctggtaggagaatccggttccggaaaatctaccgtagccagatgtctgatgaatatctatcagccggcgcagggagaaatctggtacaaagatgtaaatatctgtgacaaaaaagaattcagaaagaataaaaaaatgcttcagaccagacgacagatgatctttcaggattctgcctccagtctgaatcagaagatgaaggtgtcagatattattacggaaccaatgagaatccagcatattacaccacctcgaggaagctatataaaagaagcagcctttcagatggaatatgtaggacttgagaacagttttctggatcgttatccatccgaattgtccggcggtcagagacagcgcgtggcaatagccagatccttatgtatggagccggaatttctggtagcggatgaaccaatcgcttctctggatgtttccatacaggcacagatcgtgaacctgttccgccatctgcaggaggagcacggatttacattcttgtttattgctcacgacctggctatggttgaatatctctgtgaccgtgttggggtaatgtatcatggaaaactggtagaactggcaccgtcggaggaattgtattccaatccggtgcacccttatacaaaaacactgctgtctgcaattcctgtgccggacccgatcagagaaagaaaaagagtccttcagtattatgatggcgaaggaatggaaaacagtgtgtggacagaagtgtcaccaggacattttgcaatgctcccggctgatggaaaggggtgcagcatataatgagacaaaaaaagttagtctactatggtaaaaaatgtctgatattcctgatttcagtatttattctgtctgttgcagtgttttatgtagcacgtctggcaccgggagatcctctgatttcctattatggtgaccgtacagaaaagatgagcccggaagaacgtgaatgggcgatggaaaaactgggactgaacgagccaatttctgtgcagtatgtgaaatgggtaaaaaatgcttttcatggagaatttggtatttcatttaaatacaaacaggatgtattggaagtaattggcggtcgtattggcaatacgcttttgctgggaggaatcggatttgtcattatgttcgcgggagcattgcttctgggaatcctgtgtgcctggtacgaaaaccggctggcagaccggattttatgtaaactgggtacgatatccagctgtatcccggaattctggatggcgttggtgctgatccttatcttctctgtaaatctcaagatcctgccaagcagtggcgcatacagtaccggaaaggcaggagatgtcggagacaggttgattcatctgatcatgcctttgacgatcgtagttctggagcatctgtggtactatgcttacatgatccgaaataagatccttgaagaagtccgtgcagattacgtgcttctggctaaggccaagggattagataagaaaaagcttatgttcagacactgtgttcgaaacgtaatgcctgcttacttaagcatcatggctattgcagttccgcatgtacttggcggaacttatgttgtagaaagtgtattttcgtatcctggaataggagctctgtcttatgagagcgccagataccatgattacaatctgctgatgctgctttgtatgatgtcaggaatcctggttattttctgtaatatcgtcagtcagactatcaatgaacagattgatcctcgtatgaaggatgaagtgataaccgagaaatcggaggtggtggaaggatgacgaatcattcatttgaactggcaggaatcagaaaaacagaaactgtaatttcaaaatcaaagaaaaagtggtacgaaggtaaaccagttgtttcagcagtaatattgattcttatcatcctgggctgtctgggagcagaactgatcatgacaaaggatcctgcttatatggatcttcttaattataataaggctccaaatgcggagttcctttttggaacagataccatgggaagagatatcttttccatgatctggtatgggggaagaatttcaattctgatcggtggcctggccacggtaatctctacgtttattgcggtggtagttggcgccttcagtggtgtggcaccggcgtggcttgatgaaatgatcatgcgatttacagaagtttttttgagtataccaacactgcttctgatcattttactgcaggctatcctgggaaatgcgaacatcctcagcctgtcgtttgtaatcggcgtgaccagctggaccagtattgcaaaagtagtacgtaccgaggttcgacagattcgaaacagcgagtacatcatcgcagcaaaatgtatgggagcagggttcttccgtgttttgtggaagcatctggtaccaaacttcttctcatcgatcatgtttatggtagtcatgaatgtaagaactgcaatgatctctgaggctacattgagctttatgggaattggtcttccaatagaagttatcacttggggaagtatgctgtctctgtcagataaagcactgatgacaggatcctggtggatcatcctgatcccgggacttttcctgatcgcaacagtactttgcctgacaaatataggaaatgcctgcagagagcagacaaacagaaaagagagtaatttctgataagaaaatattgagtaagaaaacacgagaccgccattggcggtcttgttgtggtttaacatacaaacaaaagcattttttcgggctttatgggaaatctataggaagaaagtatctacaatggcaatttttctggtgttgcagatacaatctattgggagaaagtatctacaatagtgattttaggttattgcggatgaatttcattgtaagaaggtatctttaaatcgagaattatattagtcaagatgaatttatatgtgataataagtttaatagtatcttaaagtctaaataaatgtaaattgaagatgcaatcggttgtaaaaaagtatcctcggatatagaattacataaagagaagatatattagtgtcctaaatgtatctgtgataactgaaaaaaagaaaattaagatgcattagatgataaaaatacatctgtaatagtgggagtagaatagtggaggatgcaaaatgaaagaagaagctaagggcaaaggagatgtattacgaaagctgtttttttcatgtttatatctcagcacatttacatttggcggcggatatgtaatcgttacgttgatgaaaaagaaatttgtggatgattatcaatggatcgatgagaaggaaatgctggatctggttgcaattgcccaatcttcaccagggccgattgcagtaaatggagcaattgttgttggctataaactggcggggattttgggggctatgactgcaatcctgggaacgatcattccgccgtttctgatcatttcggtgatatcagtcggatatcattcatttagggacagctatattatcagtcagatacttgaaggaatgcaggcaggtgttggagcggtgatcgcatctgtggtttatgaaatgggtgtggggattgtgcaggaaaaagacaggatctctttactgatcatggccggagcatttgccgggtcctgtatatttaacatcaatgttgtatatataatcattgcctgtggaatgatcggcgtgatccgaactttcctttcaaagaagggaggagagaaatgatctatttatatttgtttgtaagttttttgcaggtgggaatgttcagctttgggggtggatatgcggcaatgccgctgatacaggaacaggtggtgacgatccatcactggctggatatatcagaatttacagatctggtcacaatctctcagatgactccgggtccaatctcaataaatgcagcaacttttgttggaattaaagttgctgggattccgggagcagttgtagctacaggtggatgtatcctgccatcctgtgtggtcgttataatcattgcgaaagtatatttgaagtatagaaagatgggaatgcttcagggaatattgaatgccttaagaccggcagtcatagcgatgatcgcttctgcaggtatatcaattttaataaccgcattctggggaactgcagttattaagttgataaatacaaattggagcctggtgataatttttgtgatatgttttgcattgctgcaaaaattaaagatgaatcccattggtgttatggttttggcagggattatgaaactggggctttcactaataaaaaaatgattcaagaatgcccaaaggcattcttgaatcggtgaactcaatcagcgtttttgctggtgccctgttcaaaaatggcaaccgctttttcatttggtgcagaagtaagttttgcaacaataatagctactacaaggcttccaaagaatcccggaacaatttcaaagatacccgtggaagcggtcataccagttaacagccagcccagatcgatcacaaatccggagatgacaccggctacagcaccctgataattaaaccgtttccagaacaaagacagcaggatagtaggtccgaaggaggcaccaaaggcatcccatgcattttcgaccatatccatgatagcctgtgcaccgctgcccttggaattagcaattacaaaagcaatcagtgagagaacaagtacaagtacacgtcctacgaacagggtctctttctcggttgcttttttgtggaagaaaggctagtacaagtctgcagtgaaggaactggaggaaactaataactgagagtctgcagtggaaatagaggctgcaatgatagctgccagcagcagtccacagataccagcagggaagaatctacgtgccattgcaatgaagacgagcttctgatttccctgagtaagcagttcggcacccatgagcattcttccgaaataagcgatcattacagcggaaaataatgaaatgattacccatacgatcgcaacaatcgaagattttttaatcatggaaggtttttcgatggacatgaaacgaaccaggatatgtggcataccaaagtatccgagtccccatccgagaccactgaggatgtcctgccagcttgtattgaaaataccgccgccgaatgcacactgtgtcacagttcctgtggctgcatcagtatattcatatacagtggtaaagaatcaggatttgcggtaatacagataagaatagatcgctggcaaaaggcagggaacgattgcagcggcaagcagtatccacatgttttgcagtggtgaggtaaggatcataatgattcctccgattaccatgcattttccaccgaagcgatgagtgtgataccagttatcaggatcatttaatgtccatggaatacgaaaaccaatcgtatagtttggctttactgtagggagaaaatttccaagaacaagataaagaactccaatgaggatcccacatagataagacatatcaaaatcatatcctaaactgtatccgtagattacagtggagacaaacaaggaaaccaacgggcagatccataaaagaaccctaaatatttttttattaatatcttttgatttgggatcaatctttgttgcgaccacacatactaaatgaactgccagcagaatcagaggcaggccaaacactgcaaaggctttggatgaatatccgtccggctgattatccagtccaaaatgtgttgcaacagaatcaggtaattgattccacaaaaacagacctataaaaactggaagcagtgttataatggatgtaagtaaaagcatttttttattttgtctgatcataatttttctctccttttaattcgttgatccataagaggatttcctcaagtacggtagcattgagttcgtaatagataaattttccttctcgttcgttacgaatcagatctgcttcttttaaaacagacagatgacgagaaatggcggcaccggaaatagaaaaatgattgctgatctcgccggctgataatcgagactgtttgagaaggttaagtatttcacgtcttgtaggatcggcaagggcgtgaagagtgtcttgcatacccaaagtcattcccccttcatttaatatttaacttaaatgttaaatgaattataacacaacatttcttgttgtcaagagttccccggtttattctgatgtttgtggaaaagtgtacaaaaacgggatagaattatatggaaaagcggaaatccttatgaagcaggaaccgataagacattttccctggatactcttcctcaggaatatacagcatatggaaatggtgactatcgtatcaatggtctggagacagagcaggcggacggaagtgacactgcaaacctgaaatatgaatcctatgagatctcaaaaggaaaatacaggtaccgcaccggtcacagtaaaaaaagcactggttctgatcagccagggtggttataagagaatcggaaaaatgatcgaagatagttttgctgaaaataactgtgaacttgtttttgattatttcaatggtgaatgcagtaccaatgaaatcaacagactgctgaaagtagttagacaacggctgtgatcttacaattggtattggcggcggcaagatttttgatacagcgaaagctgttgcgcattatgccggaacacaggtgttcatctgtccgacgatcgcgtccacagatgctccctgcagtgctttgtctgtaatctatacggatgagggcgtttttgaaaaatatttattccttccggctaatccaaatcttgttatgatggatacagagatcattgcaaaatctccagtcagacttacggtagccggtatgggtgatgcgcttgcaacttattttgaggcaagagcatgccagagaagtgaagcaacttcctgcgcaggtggaaacacaacaggtgctgcaatggcactggcagaactctgctttgataccctgatggaagaaggcgtgaaagctaaaatcgctctggaggctggtgtatgtactccggcagtggaaaagatcattgaggcaaatactctgctttccggaattggatttgaaagtgctggacttgcaggagctcatgcaattcacaatggtctgacagtactggaagaatgccatcatatgtatcatggtgaaaaggttgcatttggaaccctggcacagctggtactggaaaatgtcccacatgaagaattggaagaaattattatgtggtgtatagaagtgggacttccggtcacacttgaagaacttggagcaggtaacgtaacagatgagcagcttatggaagttgcaaaggctgcaagtgcagaaggtgatactctccagaatatgccatttacagttacaccggagagtgtatttgcagcgatcaaggcagcagatgcatatggcagatattatctaggagaagaataagcggagtataatgtttttgtacaaaagtgactttacaaatccatccggaaaaggtaagattcttttataaaatactttataaaaggaaactttgagatggttggaacggaaaagaaaaacagtacaaaatttcaaattatcaattatattataaatcataaggcaacgtctaaagtggaattgtccagaaatctgaatttcagtatgccaacggtcttgtctaatgtaaatgagctgcttgccagtggaattgtagttgaaatgggagagtatgaatctacaggcggacgaaaagcaaaaatgatcagtataaatcctgcttatcgttatgcagttggaattagaattactgcaaaacatgtagggtttgtgcttgtaaatctgaaatccgaaattgaaaagtatgaaagaatccggctggaattttcaacagaagcttcttattattcacggctcagagaagaactgcatcattttcttgcagatgtagaaaatcaggacagaattcttggaattggtatttctgttccgggaattataaagccaggtgatggaatactgatcaaatcacatgcgcttcaattagaaaactatagtcttggttttcttgagcagacattctcgcttcctgtatattttgtgaacgatgcaaatgcagcaatgatggcagaagatttagacagatataaaaatgcactgtatctgtctctgaataatactcttggtggagcattttgtattgatggaaaattaatacagggagagaatcagaaagccggtgaatttgggcatatgattctggtcccggaaggaaagcaatgttattgcggaaagctgggatgtgcggatgcttattgtgcagcgagtgcattgacaaatgaaacataccagacgttggaacagtttatgaagtgtctggaaaaaagggaagccagtgcagaagagatttggcaggagtatttgaaaaatctggcaattttgatatcaaatttacgaatggcgtatgatatggatattattcttggaggtgaagttggaggatatcttacagagtatatgattccattaggagaaaaagtaatggaatataatggtttcgaccatgatgtgagatatctgaaaatgtgttcttacaagagagaggcatctgcagtgggggcggcaaagcatttcctgcaggaatttataaaaaatatgtaattatgatgtcagcatcataaatttaaaatccagagagaaaacacagaaaagagtgttttctttctggatttttgttttgctgaaaattacttcttaatattgtagtaaaaatgcataaaatcaacggaacaaacttgtgcaataggcagaagtgaataaaaggatattgacaaatactggcaagtgaataataatgtaattactttaataaaacatttaataaaagataataaataaaggaggaattaattatgttacagcaggtaatgacaaatccaggagaaattatttttagagaagttccggttccggaaataaaagatgatcaggtattagtcaagatcatgaacattggaatctgtggatcggatattcatgtatatcatggaaaacatccatttaccaaatatcccgtcacgcagggacatgaagtatcaggagaaatcgtaaaagtaggaaaagatgcttcaggtttacgtgagggacagaaagtaacaattgaaccgcaggtttattgcggacactgctatccatgtcgtcacggaaaatacaatctttgcgaagaattgaaagttatgggattccagacaacaggaactgcttcggagtattttgcagtagatgcatccaaggtaacaccgattccggaagaaatgtcttatgaagaaggtgcaatgatcgagcctcttgctgtagctgtacatgctgtgaagcagatgggcgatgtaaaaggaatgaacattgcagttcttggtgctggtccgattggaaatctggttgcacaggctgcgaaagggatgggagcagcaaaggttatgattactgatgtcagtgatcttcgcctggataaagcgaaggaatgcggcattgatgtatgtgtaaatacaaaagagaaagatttcggggaggcaatggttgaagcatttggaccggataaagcggatgtgatctatgattgtgcaggaaataatatcacaatgggacaggctatcaaatatgcaagaaaaggaagcgtgattgttctggtagctgtatttgcaggcatggcatcaattgatcttgcagtcgcaaatgatcatgaactggatatcaagagtactatgatgtatcgtcatgatgattatatcgacggaatcacacttgtaaatgatgggaaggtgcatttaagacctttgatctccaaaacatttgcatttaaggattatctgaaggcatatcagtatattgatgacaatcgcgagactaccatgaaagttatcattaacgttcaggaaaaatagaattccaacaacattctgacagggaggaagatatggggaacgaaagtaataatgggaaagtaccgctgatcagtaagatcgcatatggatttggagatgtaggctgtaatttcagctggatgtttgtcagtaattttctgatgatcttttatacagacgtgtttggaatcagtatggctgcagtgtcagccctgatgctcttttcaagattctgggatgcgatcaatgatccaatcgtaggcggtctgacagataagactcatacaagatggggcagatatcgcccatggcttcttgtagctgcgcctattacagcgattcttctggtgctttctttttgggcacacccggattggtcaaatacagcgaagattatctatatggtgattacctattgcctgctggtattaggttatacctgtgtaaatattccatatggaacactctgtggtgctatgacacaggatattgatgagcgtgccaagattaatacttcccgttctgtgtcagcaatgattgcgataggaatcatcaatattgtgacagtgccgctgatcagtaagctgggaagcagcagtgcaaagaatggttatttgtttgttgcaattatttatggatgtatctttgctgcctgtcatttcttctgtttcgcaaagacaaaagaacaggtagcaattcctgagaaagaaaaaatctcaataaaagtacagttgaaagcagttatgcagaacaaaccatatcttctggctttggttggacaggtgttgtttggatttacattatatggaagaaatgcagatattttatattattttacttatgtagagggaaatgcttcttattatacaacatattctatgtgtattatcattccgtccattattggtgcagcatgttttcagccagtatttcggaagctgaataataaaggaagaactgcatcgatctttgcactgctcacaggtattgcaatgctggcaatgtacttcttcaatgtaaaagaatcaccagttgcattttatgcgctcgccgggattacacagttctttttctctgggtttaatacagcaatttatgcaattattccggattgtgtggaatatggcgaatggaagacgggacttagaaatgatggattccagtatgcttttgtttctcttggaaataaaatcggaatggcgattggcacagcgcttctcgcagcattgcttggaaaatatggttatgtagcaaaccaggcacagaatccggaagtaatcgcaatcatgaaacatgcattctcgacaattccgggaattctgtggatcgttacagcaattgttttgttcttttatcgattaaacaaaaaacgctataacgaaatcgtagaagatttgaaaaaaggaaaaagtcatagtaataatgcctaaaaacagaaggcttatttttagtaaaaatcacttttgaaagaaaaagaatattgaggatataaatccatgtggaggagaacaatacagcaaaaaaacactgatcgaggcagaggcagccagcccggaagcttatgtaaaagaaaacggaagatttcctatcctggaaaccacaagtaacgagaatggagacgttgtaatagtaacaggtgataataacggctcttttgtacgatatacatttacggaataaaagtgccggtaaaatataatatttgcaatgaaaaagtgtgtagcctgtgagcgtaagtccagcttataagacagggtgtgcactttttttgtgccagaaaagagaggagtaaaacaaaatggcggaaagtaacaaaatgaaggatatgccggtgaataagctgatgatccagatgtgagaagataattatggaatgtatttgatttgtttggattagcaaacttttgggtgacaaacgtaactttccgtgatatcattaaaaacatataaacgaaaatgacttttgcagaagcaggagaacagttcgaatgtatacctatacatatatatcgattgttctcttttttggctttttcatatattagcgcggtgaagttttgctcacacatagtgagatactgggatgttataaaattacctctttgtgaaagctgtaatagaaaataattggcaaagcagacgaaagtctgtgacgcaaagctacagggcctgtaaaatggcagccagttgcataagatgatgatgtgcactgtctgtctgacagtgctttttttgaggaatgacttatcggtggcggggggcaccgaaccgcaggtcactgaagtgtgataaatggtaaagaagctgatatgagaaaaaaagcaaaataacagtaaggatggaaggaaaatgaaaggaaaaagagggatcgcaggcattctgcttgtgggaattttggcggtcaccctgacagggtgtaaaaacacagacagcagtaaaaaagaaaccgaaaagccggtcatcacgctcggcagcgataactatccaccatacaattatctgaatgaggatggtgtaccgacgggtatagatgtagaactggctacagaagctttcaaaagaatgggatatcaggtggatgttgtccagattgactgggaggagaaaaaagaactggtggagagcggagaaattgactgtatcatgggctgcttttccatggaagggcgtcttgatgattaccgctgggcaggaccatacatagcaagccgccaggtggttgctgtaaatgcgagtagtgatatctataaactgagtgatctggagggaaagaatcttgccgtccagtctacaaccaaaccggaaggcatctttctggacaggacggatgagagaattcccaaactggaaaatctgatcagccttggacacagagagctgatttatacgtttcttgcgaaaggatatgtagatgcagttgccgcacatgaggaatctattgtccagtatatgaaagattatgatgcaagcttccgtatcctagaagaacctctgatgcttacaggaataggtgttgcttttgccaaagatgataacagaggaatctgtgagcagatggaacagacgctggaagaaatgcgtcaggatggcacgagcttgacaatcgttgaaaaatatctggatgatccccagaagtatctggaggtggatgatcttggatattgagagaaagaaaaaagaaaaacgaatccagctagtcggcggtctgattggaatctgtgtggttgcagtcgcactgttctatttcttttatgcggaaaaggcagaagcagagaaaagaatggtggagattgtaaactatgtcaaagtgcagtgctccacctatacccattataatgaatcttcggaatccaaaagtcttcttcgggcgattgaaagtgccagacaaatgagtacaaatattaacatagaaacagaaaacggtggtcagctgagccaggagttcctgaaaggaaacctgcagactctctgggtggatggtatcattgtactgaatgcagaaggaaagacggactgtgaatacagcacggatgaatctctgaccgatgagattacggaatacctgcaaaaagatattattatagattttgccggatatgaagaaagatcttattcggaacgatttaccagagaagacgggtcacgtatcgacattgcagcctgtgccagaaaagatgcaccggggattgttgtaatctactattatacatctcctgaatttgtcagaaactataccctgacgatacagggccttttaaacggctatagtgtccagaaagatggaacaattattgttgcagacaacgggacagttgttgccagcaatgatgagagtctgttggggcagaatacagccgacaacgaagttgttcaggcaatgaaaaagcatacagacagtcagcacatttttcacttgaaaaacgaaggaaccggatgttatggaattatgctgaagcagcgtgattattatatttatgcatatcttccggatacggaagtatttcataatcttccattaagtgtgataagcattatttttctttattttctgatattcagtatattctggctctggacatataaaaccaatctgacacaccagaagctggaacaggaaaaagatgaaaaatataaagcagaacttttgatagctgcaaaaaaggcagaagccgccaatgaggcaaaaaccgagtttcttcagaggatgagccatgatatccggactccgatcaatggaatctgtggcatggtcaatatggcagatcattatgcagatgatatggagaaacagacggaatacaggacaaaggttaaagaggcctcccatctgctgctggaactggtaaacgatgtcctggatatgagtaagcttgagtctggtgaaatcgttctggaagaaacaccgtttaatctgagcaaaatctctaaggaagtacttattgtgatcgaacagatcgctgcagaacagaatattcagatcgagtgggagaaaaaagaaatcatacaccggaatcttatcggaagtccggggtatgtgaaacgtgtgatgatgaatattttgtccaatgcgatgaaatataacagagaaaacggacatatctatatcagctgcattgaaattccatctgaacagccggaaatgacgacgatggaatttgtctgtcgggataccggaatcggaatggcagaagagttccaaaaacatatttttgaaccatttgcacaggaacatgcaggaagccgcacaaaatttgcgggaacaggactgggaatgccaatttcaaagaagctggtcgagaaaatgggtggaaccattacctttgaaagtgaagaaggcgcaggaactacctttgtgatccgggttccgttccggattgatacagacagggaaagcaaagctgaaactgaggcaaagacagaagcttccatccgcggactgcatattcttctggcagaagacaatgaactgaatatggaaattgcagagtttatgcttcagaatgaaggcgcagttgtgacaaaaacatggaatggacaggaagctgttgagatatttgaaaaaagcaggcctgacgaatttgatgtgattcttatggatatcatgatgccggtcatgaatggttatgaagcagcgaagatgatccgctctatggacagagaggatgcaaagacgataccgatcattgcaatgacagcaaatgcgttcacggaggacagaataaaagcaaaagaagcaggaatggatgaacatatctctaagcctattgatatgaaactactggtaaagataattcatgaattggtgtactagtgggaaacaatctcagaaggggggattcgtaatgaaaaagaaaaaatggaacagagtgctggctgtacttttaatgatggtgatgagcatatcacttctttcaggctgtggcggtaaaagtacggaaaaagaagatgcagaaacaatcacggtgtacttatggagcacaaacctgtatgaaaaatatgcaccatacatccaggagcagcttccggacatcaatgttgaatttgtcgtaggtaataacgatctggatttctacaaatttctgaagaaaaacggtggactgccggatattataacctgctgtcgtttttcactgcatgatgcgagtccactgaaagacagtctgatggatctctccacaaccaatgtggcaggtgctgtctatgatacctacctcagcaattttatgaatgaggatggaagcgtaaactggcttccggtgtgtgcggatgcgcatggttttgtagtgaacaaagatctttttgaaaagtatgatatccctcttccaacagattatgaaagctttgtctctgcctgccaggcatttgataaagtggggattcgtgggtttacagcagattattattatgattatacctgtatggaaacactgcaaggtctgtcagcatcagaactgtcttccgtggacggacgaaagtggcgtactgcctacagtgatccggataatacaaagagagaaggtctggacagtactgtctggccaaaggcttttgaacgtatggagcagttcatccaggataccggtctgagtcaggatgatctggatatgaattatgatgatatagttgagatgtatcaaagtggcaagcttgccatgtactttggaacctctgccggtgtaaaaatgtttcaggatcagggcattaacacaacttttcttccattctttcaggagaacggtgaaaagtggctgatgactacgccatacttccaggtggctttaaaccgcgatttgacacaggatgagacacgtcgaaagaaagcaatgaaggtgctgagcacaatgctttcagaggatgcgcaggagcggatcattagtgatggacaggatctgttaagctacagtcaggatgtggatctccagcttacggaatatctgaaagatgtgaaatccgtgatcgaagaaaatcatatgtatatccgcattgcatcaaatgactttttctccgtttccaaggatgtggtttcaaagatgatctcaggagagtacgatgcagagcaggcatatcagtcgtttaattctcagcttcttgaggaagaagctatttcggagaatatcgtgttggattcgcagaaatcctattccaatcgttttcatagcagtgggggcaatgcggcatattcagttatggcaaacactctgcgcggcatttatggatcagatgtgctgatcgcaactggaaacagctttacgggaaacgtgctgaaagctggatatactgaaaaaatggcaggcgacatgatcatgccaaacagtctgtcggcttacagcagcaagatgagtggagctgaactgaaagagacggttaaaaattttgtagaaggctatgagggcggatttattccgtttaaccgaggctcattgcctgtgttcagcggtatttccgtggaaatcaaagaaacagatgatggctatacattgagcaacgttacaatggatggaaaaaaagttcaggacaatgatacttttacagtaacctgtcttgcaataccaaaacacatggaagcttatcccacagatgaaaacattgtatttgatggaggagatatttctgtggatgatacatggacagcatatgtttcagatggtgatgccattcttgcagagccagaagactacatgactctgaggtgagaagaatggatattaggaaacatagtaaagacagaaagaaatctgtcatgagaaaacgattaaagatagctgtctttatagctggttttgtgtgcattgctttgatggttttccgatattttggatttgtgtcgaaaactgtttatgaggaaagtgtttctcatctgacggaagtttttcatcagtctgataatatgctgagggaactgacagagaaaaacctgacctatcttcatatgtggggagagaatctgcagaatacatccagtgaagatgaaattcgtgattatataaagaaagcgcaggaggataccggctttttggaattcttttttctgtcagccgacgggaactataagatgccaacaggggaaaccgggtaccttggattacaggaaaatattgaagaggagatccggcagggaaatgatgttattgcgaatgcatcagttcccggaaaatctcagctgcttgtttttgccactcctaaggctcacggaacttatcagggatttgaatatgatgccatagccattgcttatgaaaactctgatatcgtagatgtactggatatttctgctttcgatggaaatgcccagagttttgttgttcatccgaatggccgtgttgtggtcgatcattcttctgaaacatgggggaatgtgtataattttttcggtgttctgagagagcattctgatatgtctgaaaaagaggtcaatgaactttcagagaagtttaaagcaggacgtaccgacgcgatgctgctggatctggatggaagaaactattatctggtctatgaaaaatcggatatccaggactggatatttttgggacttgtccaggcagatatcgtcaatgccagtatgaacagtctgcagcgtagtacgatactccttgtcagtgtggttgtattctgcattgccgcattccttatcagttttattattcaaaaaggcagaacgaacctcaggaaaaaggatacggagattctgtaccgtgatgaactgttccaaaagctttcaatgaacgtggatgacgttttcctgatgctggatgccaaaacctatcaggcagattatgtcagcccgaatgcggaaaagctgctgggcattacggttgaacagatccggaaggatatttgtgtccttgggaaactggatcccgagaattccaaagactcggagaaaaattatctggaggagatccaggttcatgagcagaaggaatgggatttggaatatattcatctgaaaacaggggaaaaacgctggttccataatattgcaatgtgcagtgaagtaaacgggaaaaagaaatatatcctggttatgtcggaccgtaccgatgactggaaaatgaatcaggcactttctgaggcagtacgtgcggcagagacagcaaacaaggcgaagagtactttcctttctaatatgtctcacgatatccgtacaccaatgaatgcgatcatcggttttaccacactggctgtaagtaatattgatgatcagaaaagggttcgggattatctgggcaagatcctttcctccagcaaccatctgctctcactgatcaacgatatcctggatatgagccggattgagagtggaaagatccacctggaagaaacggaggtcagtctgtcggatgtgcttcatgacctgaagacgatcatcagtgggcagatccatgcgaagcagctggagctttatatggatgccatggatgttacaaatgaggatgtctattgtgataagacgcgactgaaccaggtacttttgaatctcttgtccaatgcggttaagtttactcctgcaggaggaactgtctctgtccggctgaagcagttaccggggacagcaaaaggtagtgcactgtacgagatccgggtaaaggataacggaatcggtatgagtcaggaatttgtgaagaagatcttttctccttttgagagggagcgtacttccacagtcagcaggactcagggtacaggacttggcatggcaatcaccaagaatattgtggatatgatgggcggtaccattgaggttcagacggcacagggcaaaggtactgaattcattgtccgtctgccattccggattcagcctgagcagcaccgtatagagaaaattgcagaattggaaggccttaaggcactggttgtagatgatgacttcgatacctgtgacagcgtgacaaaaatgcttgtgagggttggaatgcgctcagaatggacactttccggcagggaagctgttctccgtgtacggcagtctatggaactgggagatgccttccatgcgtatatcattgactggtgtctgccggatatgaatggaattgaagttacgcgtcagatccgcagccttggtgacgatacaccgattattatcctgactgcttatgattggtcagatatcgaagcagaagccaaagcagcaggggtgactgctttctgtgcgaaacctctgtttatgtcagatatccgagaaaccttgatgacagctatcggtcagagtcaggctggagcagaagattcaattcttccggaagcaggttcggatttcagaggcagatgtatattgcttgtggaagataatgagctgaacagcgaaattgcggtggagatccttaatgaatatggattcctggttgatactgcaaaaaatggagcagaggcagtggagaaagttaagaattcgactccgggtaattatgatctggtgctgatggatgtgcagatgccggtaatgaatggatatgaagccactaaggaaatccgtgctctggataacccggcactggcggggattacaatccttgccatgactgccaatgcctttgatgaggacagaaagaaagccctggaatgtggcatggatggattcttatccaagccaatagttattgaagaattgatcagtaccttacatgacaatctgctgggttaggcagcagatgtacgttttgacagccgaggacagttcgcagcatgaaactgtcaaagccggttgtgcctgagaaagtgataaaaacaatttcaggatatgttcactaaactatattaatgaaggtataagaggaagggatcataatggataaaagacaaaaaatacttattgtggatgatgcggaatttaacagggttatattgaaggagattctcggagaaacttataattatctggaagctgaaaatggaaatcaggcaatccagatagtggaagaaaatccggagattgacctgatgttgttggatatcaacatgccacagatgaatggttttggagtcctggaatggatgaaccgtttccaatggatcgatgaaactccagttattatgatctcctctgaagaatctgttgatactatgcgtaaagcctatgagatgggtattaccgattatattacacggccttttgactctgttatcgtaaagaaaagagtccagaatacactggcactttatgagaaccaaaagcgtctggtaaatgtggttgtagaccaggtttatgaaaaagaagaaaacaacaatattatgatcggaattttgagtaatgtactgggatttcgcaacagcgaaagcagtgagcacattctgcatattaaaacagcaacggaaatgatgttaagaaaattggtaaaagtaacagatgcttatcctctgacagaggcagatattgctttgatcacaactgcatcctcccttcatgatatcggtaaagtgggtattccggaagaaatactgaataaaccgggcaggctgacggatgaagagtttaagattatgaaaacccacagtgagataggcgcatccctgatccgggatatgcgcttcccaaaggataaaccattggtgcatactgcatgggaaatctgcagatggcatcatgaaagatgggatggaaaaggttatccggatggactgaagggtgaagaaataccgatttctgcacaggttgtatcgatagtcgatgtttatgatgcacttaccagtgaaagatgttataagaaagcatttgatcatgatacagcaatccgaatgatcctggatgggcagtgtggacagtttaatccagttcttcttaaatgtctgaaagaactcagccttcaattttccagaatgtttactaataaaccagatgataataaacagtattatgaagcgcagagactctctgatgaaatacttagggaaaagtctttaccccgtaaaaattattcccagcgtgtcattaagcttatgcaggaaaagattgagttttttaaaacgaatagtggaaaaacctccattgaatacaatgtcatttcaggtcagcttagtataatgaatgaaaaacagcagataatatgtcaaaaaaatgatccgaagtacgatatatctaatgtgtttgaagtaaacagagaagatatacggcaagtcagtaatctattggatcagacatcaatacagaataaagaggttttattgcacgtaatggcaaaagtagagaacaaaaggcagatgtgtgctctgaagctgcacaccctatggtctcctttaaagaaagatggttatataggaattgttggatattttgagagtatataggttcctgaaaagtgtagtgctgattttttccaccatattaatgtattttctgaaggagtatgatacaattggttatgaatactaagaactaaggaaaaaccatgtatgttaaataaaaaagatttcttgaaatatgcatcaaaactagcttttccgatcatgatccaaaatctgatcggaacactggtaaatattgccgatacggttatgcttgggtatgtaagccagactgctatgtcggcttcatcccttgcgaaccagtatacttttattcttttctgtttatattatggcatggccacgggtgcttcagttttatgtgcacagtactggggaaaaggtgataaaaagactgtagaaagaattctcggcctggcggaacgaatctcactgatcgtttccctcgtgtttttcgtgatctccttttctatgccaactacgatcatgaagatctttacaagcagtccggatacgattgctgccggcagtgaatacttaagggtaatttcattttcatttatgtttatgggattttctcaggtttttatgagtgcccttcgaagtatcggaaaaataatgctgccatctgtcacgtacattgtttcgctttgtgtcaatgtaatttgtaatgcgacctttatctttggtctgtttggacttccaaagcttggcgttaccggtgtggctcttggtactgtcattgccagaatcacagaagtactgatctgcctcatctattcattaagaagttccgatgtcagattccggatcaaatacttctttacgaaatcaggtattctgttccaggactttatgaaaattgccaccccggctgtaataaatgatgttgtctggagttttgccagctcagcattcgcagcaatactcggccatattggcgatgatatggttgccgcaaatgcagttgctgtcatggtggtaaatattggtgcgatcgcctgtcgtggttttgccaatgcgactaccatcattgtcagccaggaactgggtaaagataacattgatacagcaagagaatatggaaagcgcatgctcaggataacaatggttgtaagtctggtcggatgcgttattattctggcacttcgtcctttgatactggatttctatcgggataaactgacagagacggccatttattatcttggcatttttataattatgacaacctggcgtcttgtgggagaaggtatcaatacctgccttatctgcggatgcttcagaggtggcggtgattccagatttggaatgatcatagattccatatttatgtggcttgttgcagtgccgcttactttccttgccgcatatgttttaaaattgcctccaatctgggtgtactttgtaatgactctggatgagttcgaaaaaatgcctgtggtatttattcactatttcagaggcaaatggctcacaaatattaccagagattttgattgatttaatggaggagcgaaacatgattatcagaaaagctaaagaaaaagatattccaagaattatagagctattaggacaggtgttgcagatccatgcagacataagacctgatatttttattcccgatacaacaaaatatacagtggaagaattaacagagcttttgaaaaataaagaaaaaccgatatatgttgcagtgaacgagtctgatgtttgtgtagggtatgccttttgtcaattgcaggaacagcccttctcaaataatatggtacagtttaaatcgctttttatagatgatctatgcgttgaccagcaggcacgaggtcagcatatcggtgaaagcctgtttgagcatgtaaaaaaagaagccaggaaaatgcactgctatgaagtgacattaaatgtatggtcaggaaatacttcagcagaaaaattctatgaaaaaatgggaatgaagacaaaagagaggcagatggaatacattctggatgatttatgaaaaaagcatttaagagatttagaatcgtattctgctgtggtaataatgactaaaaacagaaggtgcttttttagtaaaaactgcttttgcaaccagaataaaatagttttataataaagatagtggcgagtggcgtaatcatgcagaaaagcaaaatatacgttactcgcctttacaaaattaatttcaggaggaagcagatatgcatgagtatgaaatttttattgaggatataaatccatgtggaggagaacaatacagcaaaaaaacattgatagaggcagaagcagccagcccggaagcttatgtaaaagaaaatggaagattcccgatcctggaaactacaagtaatgagagtggagacattgtaatcgtaacaggagataataacggctcttttgtacgatatacatttacggaataaaagggacggtcagtaagtttaaaatataatattcgtcatgaaaaaaagtgtgtagcctgtgagcgtaagtccagcttataagacagggtgtgcactttttttgtgccagaaaagagaggagttagaacaaaaatggcggaaagcaacaaaatgcaggcagtcaagaacatatttatcggtgcaatgagggtgatttctttaagtttcttgtttgccggaatcaatgttgcttatcagagaatttatcaggcactggatggaggtatggaatcactggttatttcacttttgagacagcttgtaatcattttaccattggcgggaattttttctatatttgtcagaaatgcacagaaaccaggacttatcaaagatccatatatttacaaaccggattccatcatgctggatatggaagatgcagtagcagaaaatcagaaagatgcagcacgtttttcactctatcatgcacttaagacgattaattatcgtgtttgtgaacgagtagtcagaatcaacggactggacagcccttactggaaagaagacattcgttgttcagtagccggtggatgtgattctattcgtattcctaagacagaaagtgcacaggatgtgcagcttgtagagcgtgagatcatttcagcagaaaaagaatttggacttccggaaggaagtgtcctgatcatggcagctgttgaatcagcaagaggtgttatgaaagctcttgatatctgtgaatccagcgagagacttttcggtatcgcactttccggtggtgattatacaaaagacctccagacacacatcacaggaaccggaatcgagcttatgggtgcaagacagaacggttgaatgcaaaagttattgcaacccggggggggacgttttcttggactaaattgctattcctaaactacgtctatattgaaatggactcattccacccaacgataatgacatcctcgatcagaatgaactagaggatgctctgaaggatcaattaatatttttttccgccataatataaaaaatggtggcatttcgtatttgctgaaggtacatgaaagtgttctcctgttaaataatattctgtaagttattttctatagatgtccgctgatagtaggtatctatgatatcctgtaaagtaatcgtattcattttttcttcggcatccttttgaatttcattgtaaaatccctgcaaagataactgaatgttaatgccaacgccgcaatcagggttggtatgagtatctaaatgaagcaaaggtttatcaccttcaactgctttataaatatccagcaatgtaatctgttctgctggttttgaaagagaaggacgggcatgtccggctacactggtcataagttccgctttttttagttttaacataagctggcgtacaaagccgggatttgtatggacactttctgcaattgaggcactggagagggatttttcctggttgatagcaatcagaaccattacatggacagtatcgcttaatttcgttgagtatttcatgataagaaactccttgtagtatgatataatgattttggtttcacgtttttgaggcgaaaatatttctggtttgtttaaaacgtcctaagttctcaacagttctttttaatgtgttgataaactgtacatttttttatgtttgatggttgtaaataatataattacaactataatggggattaaaggaaaagtcaacacagtaatgaaacttacggcaaaggagaacttatggaatacaaaaatcaaacagaaaatcgtgcatttcaggaaatgttgcaggcggcagtaaaacggctgcaaaatcgttccggagaggagattgctgcaaaaagtggggctgtttttcatagcagccgaaatgtgcttgaagtactgagtttttatgaaacgattgaaattcaactccctgagtttcgtattaactcaaacatggacgaatggcattatctgacattgctgcattatctggacatggccgatggaacagaaggttcacagaagctcattacttttggtaacctgaaagatggattgattcgggggactaagtttgaccggactgcagagcagaaactggaaaagcttttgcaggacaaagatcctgagaaaattcagaaagcatgtacaagtctgggtgcagaattcacagagacaacggcggatctgtgtgctgtttttccagttctgccaagatatccggtaactttaaagatatggtttgcggatgaagaatttcctgcatcgggaaaactatttcttcaagatcatgccgatcattatctgagtgtagaagatgcggtaacagttggagaaattttactgcaaaaattatcggaagcattttcttccctctgatcatgaatcagaaaactttccagtccggctttgataaatttgtcgattactgtctgaatctgtttccagtcattacagtgattgcggagcatcagtctgttgatggaaaggcagccgttcatttgaaaataaaaaaccgattctgcctgttcaaaggtcaggaggctgtgtgacataagccaggtcacatagccttcttttgtattttctgctattttttccagaagaataggggcaattgcatcatccagaaacagtgccctgtattgtgattccatctgtattttctgacagaacggataggaacagcttttttgatttagacagaataaatgatctacagttgttaacatatcctgagtcatatcattaaaaatatctgataatacatcatggatatcgtagtaatgaagataaaaagtgccacggttgatttcagcatttttgcagatctctgtaactgtaattttcgtaaaacttttctgcgttaacaattctaagaacgtattttttatggtttgcctggtatagcgggtacggcgatcttgttttctggttttttctgacattatatactcctgtattatttggtatcgtatgattcctcaacaatttttctgatgtgttgagtagccatacaaatctcaaagattgattattgtaatttatatagtaacaactataatggggtttaaagaaaaagtcaacagattgttcagaatattaggaggaaaaacatgggacatgtaattgcaatatcaggaaaaggcggcgtaggaaaaacaacactttgtggattattgatccagtatttgtgtgaaagtgggaaacgtccggttctggccgtggatgcagatgcgaatgccaatttaaatgaagtgcttggtgtggagccggagatcacacttggagagctgagagaagaaattgagcgggcaggcgtagatccacgatatcagatcccatccggtatgacgaaacaggcatatctggaaatgcgtctttctgatgcgattgcggaagaagatgattatgatctgatggtaatggggcgaacccagggacaaggctgctattgttttgtaaatggtcttgtgcagacccaggttcagaaactgcaaagccattatccatatattgtggttgataacgaagcaggtatggaacatatcagcagaggaatcctgccaatgatggaagttgcgattcttgtaagtgactgttccagaagaggtgttcaggcagccggacgtattgcaaagctgatgaaggagttaaactttaaaccacagaaaaccggattaatcgtgaatcgtgttccggatggaaaactggatgccggaaccctggaagaaatccgaaatcagggactggaactgttaggggttgtaccacatgatgatcaggtatatcagtatgactgtgatggaaagccgatcatacagcttccgaaagattctcctgtaagaaatgcactgggagaaattgtaaagaagttaggattgtgagttggaggattgaaagtatgaagattgagtaaacagaaatattatctgatttgatataaccaattgcaaagaaaggaaaatcttcatgagaaatcattggacagaaatagaaaaatatttagaagaccagaagatagcgcaggaactgattggagaactgagagattttcacatgcgttatgaggtagagaatcaggtaaaggaacgggtagaaaaaccggatatcttattttatgggaaaaagattctggaaatgtcaatagcagcgcttcttcaggaagataacctgttactttccggtgcgaaagctacaggaaaaaatgtactatgtgagacactggcatggatattcggaagaccggaatacgacatttcttttcatgtaaatacagacagtgccgatctgattggaacggatacctttataaataatgaggttcgccttcggaaaggccccatctaccaatgcgcggaatttggaggatttggaatcctggacgaaatcaatatggcaaaaaatgatgcggtctctgtactgcatgccacactggatcatcggcgcagaatcgatattccaggatataacaggattttacttcatccggcaacacgatttatcggcacgatgaattatggttacgcaggtaccagagatctaaatgaagcattggtttcaaggtttatggtaattgatatgcctgaaatggatgaggatagtgtcctttttgtattaagacaacattttccagaggggaaaaaaagtgcattgaaagcttttgcaggactgtttctggatttgcagatcaaagcttatcatggagaaatcttaacaaaatctctcgacctgagaggattggtttctgctgtaaaagcaacaagaagcggactttctccaattgaagcaatccagatggggatcataaataaaagttttgatgtatttgaaaaagagatcgtagaagatgtggtttctaccagaatcccatcttcctggaccggaaaagacatatgggggtaaacttgtatggaggatgtcagatggccggcggaacaactggaagaacatcgtctggaggtcagcaatcgtatcagaaatcttttttggacagttagtggtgattatgatatagaatttgaaccggacacagaaaaatatgtttattcaaaacaaacggttctatatgaggcagtgaagcagggtgcctttgcacgatattttgatcagaagaaacttggcatgtatttgatgaaaaaaatacatttttctgctggagaagatatgcttttgcctcttgctggattatgcatggatgctgcagtgaatcgttttatcattcgagaacgtttgggaacaaaggaaatcagagaacaggcattcggagaattggaaaaggccgaggaagagcagatatcagataatgctggaacagacctgattcacaggattaggcttttgtatataaggcatgttctggagaacacagacgatgagggaatggatccacaggcagagattgcattgtacaagattctttctctgaaggatgcggaaaatacggaagatgtcataaacgtgatagatgagatttataatcatgttctggatccctcttttgaaaaaaggaatggaaatctggagaagattctgaatttaccggatatggcattagccaatgacgcgtggcaggaatgcatgacggatgaacagatggaagacatcattcaaaaatatctttctaatctcaaaaaaaagatgatgagtctggatatcagaaacaaaaagaaaaaaagattttatttctctccggaaaatgaagaagttccggaaagctcggagaatataaatccacaggcagtgcgacggatacgggaatatgtggaactgaattacgggaaatcgtatctgagtgaatcggagcaggccagaatcaaccggaaattttgtacaggaatccacaaaaactgtatcctgtatcttacagatggaattttacagaaccctgtcataaaaaataatcaataccgtttttctcagctgcagtttgaaaaaaataaagcctattatggaaataatcactggatcatcaaaagaaatatttctgtgttggcagagtcactgaaacgggcatttataatccgaaaggatgattctgtcagcagatctgatgcagggcagcttgttcctgaaggcagataatcatccagatattcaggatgttcaagaaaagcactccccggcatgtcggacaggatatattttatatatttcatcggggcaagcccattcgctttcgctgtctctaccagtgtatagattcctgcactggcttccgcccctttcggactgccggagaacagccagttctttctgccgatcacaaagggacggatacagttttccgcaagcgaattactgatggaacaattcccgtcttccagataattccaaaaaccttcacggttatttaaggcgtaatgaaaagcttttgaaagtttggatttcggcagctctccgatggcacttttttctgcccatgaccaaaaagcctcgagaagcggtttctcgcggataagacgttcttttttcttctgatcaggagggagcgcctccaactctgactctatgttaaagagttgattcagacggaggattgcttccgcaggttttgatgcttccgaattatggatgtcttttgggagcgcatccacgaaagcccggcgcagatgcgtatagcaaagacatctttttactcctgaaactgcattgtatccggagtaagcgtctgtatggatataaccttcatattccctcagaaacgcttccggatatttcccgcttcgtcccggctggtactcgaagtagcggatgggatttacagcatctctgatgctgcagtaaacccacatataggaatcggacgtatttttccgtcccggttctttcagcacctgtacatgtgtttcatcgatatgaaggtatctctgtttcagaagttccagcttcagacggtggacgatgtgtacaagccagtcccgatagacaaccagaagccagtttgacatagtcgctctgcttaaacgtaatcccaaagcctcccattctttttcctgtctgtacagcgggatgcttaattcaaacttctggtggatgagccaggtgatggtagatgcagatgccagagaatgcaggacgggaggatatggcaccggagccttctccatataaggagttccgtttttccggcacgacctgcattcatacgtttcccggtaatggtcaatcaccttgagttttgcagggataaactgtacttccgtgcggacgaattcttcccctactttcaccatcgtactcccgcagttatcgcatatctgttccctttcatctatggtatggagtactttgctgtgagggagattttttaccagttcttcccgctgaccggtgtacttccttttacgtaggtgcttctctatctcaacaagctccggttcgtgtgcatcaggatccgcacaggtttcgatttcattaaaaagagacacctgcccctcgatttcgagagtagatgtcttctcggattttgttccataaagtttacgggtcaggaaatcaacctgctctttcaggagccggacctgctgttccagttctttgatatgatttttatactcctgttccgtagctgacataacctgaaaaccctttcgtttcgataggattattataccatagaatcgtcagatttcccagcatttctaaggattttcagtattttcagacttatgcgggagccatttctgaaccgcctttggctgctccgggttcaaaccttccagaagccagcgcagctgctgatcagaaatctgttttgcttcttcgccggtccgcggccattggagacgtccgttttcgtaccgtttgtataaaaggcagaaaccgtctccctcgtaatggactgctttgatccggtcagccctctttccacagaacaggaataaggaattgctgtaaggatccagtttgaagttgtactggatgatatccagcaagccattgagctgcttcctcatatcggtgtagccgcatcggatatagattttctccacatgggaaagatctcctaacatgactgcacggctttcagaatgttttccagcatctgggcagatgtgccttcataaagttccactgttatggatccgatatgaagtatggctgcaggagtggaacgggaaatgtttctgtccggaagtgaaagctccgcaaactcagccggggattccgttaaagcagttgactgttggtctgtacacatgtggatgccgtttttcttgcggggcagttcttccagggcaagctttcgaattttggaaagccagtaataataacttttcaaagagatatcgtgttgttcacaccagatctgatttgtcagtccggaggccctgcattgccgtattacatccagccagtattgaagtttcacctgtttgtctggagtcaaagaagaaagatccataagcctgctccttagattagatttagagtttttagagtcaactcccaaaactctaatcaatagtttacatgcaacagccagaaatttcgatacaccctcttattggacgcttacgtagtaacaatgccccttaagggatagcgacgagtcaagagcaatatggcttgaacggagctgtgggaggaatgtgaaaacagaattcccatagcctaaagagaaagccagcgccttgagacgctggcctagtaacaagggcttatagccctagagcaaaccacccgttggacgggtggtcatgattttaccaagattatttctgcaaaatcctccaaagcgtagacctgctgatgccaagtctttcagcagttttggttttgttcatgtgttcctgctccaggacgatccgggagacgtcatagttaatactgtccagattctggttcaggttcaggatttcatagcctggctgaagctggaaggtatactgggaactggggctttcctgggagagggcctgacgcacaacgtcagttttgatatagtaatcattggtggaaatgatcagctgacgaatgacacgcttaaactgtgccagattctgaggccagccaaactgctgcattagctccatagcctccgattccagccctacaacctgcttcccgaattcaacgtttgcctgactgatgtacaaggtagtaatattgggaatgtcctgcacacgctcccgaagaggcgggatacgaagaaccaggcaggacagctcattcataaaagtctggcagacggtgtccgtttcctgcttgtcactgccaagagtataggaaaaaataaaacggttccgacggcacatctcaccctggttcaagtaactgagaaacttctgtgccagagaaatttccagtgcctgaagattttgaataaaaatcgtggtgttaaggtcattaaaaggcgaatttacattatcaatgagataattccattttttctgattggtattagcacagtcgataattacataaggactcttccggtattcactgtgagagtacaaaaaggaagccgcctttgtcttgccggttccgatttcacccaggatcataaccggtgccagggtagcggcatattgctccatgatgattcttgtgctgccgataagattggcactgccatagtaatcagaaacctcattaatggagttcgtcttcacgtcataatgagaaacgccgatgtcatcgaccagcagcggtgcatcctgcatcagaaggtaaatatatacataagcaatgccattgatagtaatgtgtctggaatacatggtgtaaacaaaactgtctacctgattttccagccggaagcgggaatcggaaagaaaggaagcaagattctgctccacctgattaaagaaagcagcagtggcggggctcctttccatactggaaaaatacggctgaccatccttggtataaataaacaatgcttcacggctctggataactgcagctttcagaacctgagactgctgtctggtaatggaaaatattttggaaaaacgtactgcctgatcgagagcggcttcaatactttctcttccggatataataagaataaagttcatccccagttcacgggcaatagaagtaccgaccatatcacacaaaaccatttcatagccttgctccttcagatgctccatctgttggtaaggctccgtattttcatccagaacaataatctcaatatcatattgaagaagattgcacagcattttcgcacaatttgtaatggccggatagccgataatggcaaaacggttggaataattttccgcaagcttgatggcacggagaatatcatatacggaaatctcaacttcgactaccgggatagtaacattggcagaaatcatcttcgcagtaccgccacgggaaatgataatatcgaaatcgtccaaatcataggattgtacaatttcaaggcctgtagccagatctccgattcgagtagtcatttcgatatcatcacggccagaagcgatatcgttaattatttctttcatgccctgataaggagctattgttaaaatctttgtcttcatacgcacacctccgttgaaacaatcctgtctgtaacgttgtttcataatggcctcatttggattacttatatgataacatacagatgcaaaatagaacagtattttttgaaaaacaataaaaaaagtcatgtgtatcatattcgaacaaataaaacgaaaaactgccttgaaatcaaatggtacaacatggtaatattgcattattaaatggcggaacttgtaatagcgttttaaaacgaaacactaaaactaaaaagagggaaaattaaaggaggaaaattatgaaagcaaagaaagtgagcgcattattagtagcaaccgcaatggtatgtggtatcgctggaggaacaacagcagttcatgctgatccagagtacactattaaactctgtacagagcagacagacggtgatccgattgacgaaggctgcgacaaatgggctgagttagtagatgaagccacagatggagctgttaagattgaggtatatccaaacagccagttaggtgcaaaagcagatctgatcgagatggcacttgcaggacagggcgtatgtactattgctgatggttcttacctgatggactatgtatcggatttcggcgttgttatgggaccgttccttttctctgactgggattccatgtacaaaatcacagcaagtgactggtgggctgatgaagcaaaacagttggaagatgaaggtcttgagattgtttctacaaactggatctatggcgagcgtcagcttatgacaaaaactgaggtaaaatctctggatgatcttaagggactgaagattcgtgttcctaataatgatatttccattaagatgtttgaccttcttggaagcgcagcaactccaatggcattatccgatgtttacacatctcttagccagagcgtagttgatggtgtagagaatcctctgacaactctttacaacaatgcattccaggaagtttgcaagaatgttactatgacaaatcatcagatgacattctccaactttatcatgggtaaagatttctgggatagcattccggaagaatatcagacagcaatcatcaattgcggcaaagaagctgctgagtacaacaacgacctctatcagaaacagagcgaggaaatggtagctgctctggaagatgccggatgtacagttacagagcttgacgatgctacatatgaagagttcaaaaatgcctgcatgaaactgtatgaggactatgaagcggacggaacctggagtgaaggtctgtatgaccagattcaggagattattgctgaataagtaatatgacagatagtccctgaaggaggtaacatgaagaatttaaagaaatttgtttgcaatcttgatgttattatttctggattaagtctctgtgcaatcgtagttattacccttgccggagtaatcatgagaaagataatgaatcagccgattgcatggctggaggaaatgcagcttctgctttttatatatgcgattttcttcggcggaagcgtggcattccgttacggaaaccaggtaagtattgacttggtaatgaaccggttaaaaggaaaagctgcaagagcgcttgagatttttgacgtagtagtaactgtgattgtgttgatttattattgctatggagggtatcagctgatgtcctctgtaacaaagaaagtaacaccatatttcaagattaattatgcatttattgatgtagcggcaccgattgggatgatcctgatggcaattcagtatattgtatatacatatcgtcatctgaaaggtcttggaaacccaggagatgaccagaaagcacttttgaaaggagaagaagaatgagccctatcgctatagcagcaattatcatgctggttttactttttcttaatgtgccggtctttgcatctgttctgggagcctgtgttacatactttgtattgaacccctccgccggacttgatggaatgctggcaatgcagcgtgtgatcagtggaattcagtctgtacccatgctggcgatccccttctttgttgcagctggtgcactgatgaattactgtggtatcactgacagaatgctgaaattctgtaaggttttgactggccatatgtatggtggtcttggacaggtaaatattgttttgagtacccttatgggtggtatgtccggttcctctctggcggatgcggcaatggaagcgaagctgcttgtaccggatatgagaaaagccggatatccaaacggatatgcatctgctatcaccgcattttcttcaatgatcacacctttgatcccgccgggaatcgcagcgattatttacggaagtgtaaccggaacttctatcggccgcctgtttgtggcaggtattgttcctgctgtcatcctttgcgtggcgatgatgataattgtatcaaaatattccaagaaacgtggcattccgcgccttagcgagaagagggcatctggcggagagctttgggaagcatttaagcctgcaatccttcctttgtgccttccgatcatcatcatcggaagtatccgtctgggtatctgtactcctaccgaggctggtgcagtcgcaattgcttatgcagtaattcttggtattgtttacagagaaatccgctgggataacgttttaacctgtatccgtgaaacagtttgttctacagcatctatcatgcttatcgttggtgctgcatcctgcttctcatggatccttacctgggagaacgttccacagacaatgacaaccgtattgatcagcgtatgcaagaataaatacatcttcctgcttgctgtaaacattttccttcttgttgttggtatgtttattgaggcaacagctgcccaaattgtactcgctccaatgcttgcgccggttgcaatagcttttggagttgatcccgtgcattttggaatagtatttattttcaatatggcgcttggttctctgacaccgccaatgggcaacctgatgtttgttacctgcggtgttacaaaatgtccgacggaggagtttttgaaagacagtgttgtattctacatattgattttcgcaatattgatgctgatgacatatgtaccgtttatttcaacctggctgccaaatgtcttatatggagtgtaaaaaaacatgaagataatcagaaccgttcttggagatatacctgcagaccagattggtgctacagatgcccatgatcatctgattagaagcgggggtccggagattaagctggacccagcttttcttatggatgatgtagagactgcaaaaaaagaatttggacgtttcctggatgccggtggaagaaccatggtttgcatggatcctatcggctgcggaagaaatgtttctaaaatgctggaagttgcaaaggcatacgagggaaaaggaaatattgtaatgacgactggtttccagaaaggcggcaattattgcccgaatacttccttccttgcaactgttgacacaaatattgttgcaaaatatatgatagcagaagttgcagagggaatggacctgaacagctacaatggtccttatgtggagagaacgattgcgaaagcgggcgttatcaaagccggtacaagttaccgcattattacgaagctggagcagaaagctcttgcggttgctgctattacacaaaaagaaacaggatgcccaatttccatgcatacagacttcggaactatgggatcggagatcctggatgagatcgagaaaaatgggggaaaatcggagaaaaccgttctctgccatatgcagagaaacccagatagatattattacagctctattctggacagaggagcaaccatctgcttcgatgaaccgaataaagcggcttaccgtccggacacagagattgcggaaaatatctgctggctgctggatcgggggtatgagaaccagatcgttcttggcatggatgccggaagagtggaaggacttgcttcctatagagaatcggttggaagagccaatggtctggagtatcttctcacacggtttgttccattgctaagaaagatgagtgtttcagaagagaaaattcacaaaatgctggtagaaaatccttctaatgtattttcgattgaggtctaaataataaatgtaaaactaacagcgggaggctgtgattcgtaacaaggatcacagcctcctactgtttatggactttagtctgttgagtccattggagtttttcgttgatccgaaaaatgtagatggacgaaacaattaaccacccgctatgcgggtgcgcgtcgattgtttttaaaaaaaattacctttccgtgtacaataaagttgttcaggctatattgtagaaaggaaaggtaatttatggcgaagaaagaatattcactcgcacatacaaaatggatgtgcaaatatcatatcgtcttcacaccaaagtatagacgaaaagtaatttataatcaatataaagcagacatccgagatattataaaacaattgtgcagttataaaggtgttgaaataattgaaggacatctgatgccagatcatattcatatgttagtaagtattccaccgaagataagcgtatcttcatttatgggatatctaaaaggtaaaagtgcacttatgatatttgacaagcacgcaaacttaaaatataagtttggaaatcgtcatttctgggcagaaggatattatgttagcacagtaggattaaatgaagcaacaataaaaaagtatatccaggaacaggaaaagcatgatatcgcaatggataagttaagtgtaaaagaatatgaagacccttttaagggttaatgctaagtagtaacaatgccccttaagggatagcgacgagtcaagagcaatatggcttgaacggagctgtgggaagaatgtgaaaacagaattcccatagcctaaagagaaagccagcgccttgagacgctggcctagtaacaagggcttatagccctagagcaaaccacccgttggacgggtggtcatgattttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacaagggcttatagccctagagcaaaccacccgttggacgggtggtcatgattttgtgctgcggataatggacgggcagcggccggatttgagcagaagcagccgaaatgacagacataaggattacagagataagttaaaagggagagcttgcagggtaaaatgtttcagaatggaatcttttttgataaaaacaccatcaaatcggttcaaaataaaacataagagaattgaaaaactctaaaattgacgaaaaatcataaatatttcatattaaaacaaataaaatgaaacacatggcttgaaaaaggggtgcagaaggtggtattataaaaccatcaaagaacagaacacaaatgaacgtttaaaattgaaactaaaataccaaagagggatgttttaaggaggaaaattatgaaagcaaaaaaaatcgttacattattagttgcagcagctctgacttgcggagtagtcggaagcacaacatctgtatacgcagcagacgttacactgaagcttgcacacgctgatgcagagggaactattttcgatcagggtgcagttgcatttcaggagaaattacaggaactttccggtggaacaatggacgttgaactttatcgtaatggtacacttggttctctttcagaggttgcggaaggaattcagatgggaaccgttgatgtagcaccaatcgttaccacaacattagcaaactttgcatcagagttaaatgcatttgatatgccttaccttattgatgattatgatatggcttacgaagtacttgatggggaggttggacagaaatttgcagattcccttcagggcagcgcactgaaagtagaaggctggtgggcgatgggattcagaaacacaaccgcaagcaaagaaatcaatggcgtagacgatttcaaaggtctgaagatccgtacacagagctccgatattcagatggcaatcttcaatgcacttggagcaagccctacagcaatcagcttcagcgagctctacacagcattgcagcagaacacagttgatggacaggaaaacccatacgtaaacatccttcagagcaatgtttttgaagtaaacaaatatctgatcgagacagagcacgtatttcaggtagcagcattcctggtttccccatctacctatgacggacttaccgacgaacagaaaggctggtttgacgaagcagcagcttatgcaacagaagttgaaagagcagcttgcgagaacgacaatgaaacagcaaaagaaactctgatcaatgacaagggcatgacattaatcgaacttgacaaagatgagctgaaggaagctacaaaatctgtatatgaccagttcccggattatgcagacactgttgctgaaatacagagttacgcaaaataaattgtctgtgctctgtattcaggtaaaactgatacagggcactgcttatttctaaaagctataaagaggagatgcgagaatggataaaatagcaaagaccctgaaaaacatcagtaataaagtttacatcgttgagaaatgggtcctgatgatcgctgttatcgcagtgaccgctgtgaatttcgtaaacgtaatcatgcgttacatatttaagagtggccttgcatattgcgaaaacttaagtcttacattgtttatgctgctgattcttattggcggaaacattgcagtaaagtctgattcagaaattcgtattgatgtgtgcagattcaaagatgtgagaaaaaagaatgcatttaaactgatttccgatatctgcagcatcattgctttggtatgtctgttacttggttctatcgcattggttcagcacacagcacagtacaatcagcaggtagcaacacttcctattacatacctgcagctatacagcctgttaattatcggttccattttaatgttatttgatcacgtagtggttttatttaaacatctggcagcaatccagacgggagtagaagaggaggcggaataatgaatcccatacttgttttattaatcgtatttgtagtgactttaatcttgggagttccgtttgcatggtccttacttcttgcaagtgctgcatccgtttgtatgatcgacggacttccactgatgcagatcgcatctaagatgtataacggcggtgccaaatatacacttcttgcaattttcttctttatgctggcaggggcaatcatgcagcatggtggtatttcaagccgaatgatcatgttcgcaaaagcttgtgtgggacatcttcgtggcggcctttctatcgtagttcttctggtatgtatgctgttcgcagcactttccggatcttccatcgcaacaacagcagcaatcggagctatgctttatccggagctggttaaagaaaactatccgaaaggatatgcagctgctcttccggtagctggtggtactcttggaatcgttattccgccaagtatcgtattcgttgtatatggttccacaaccggaacctccgtatccaaacttctgatgtctggtgttatccctggaatcatggctggtgtgtttatgtgcatctacgcatatctctatgcacgcaagcatgacattccgaaatcaaatgacttttcctgggcaaacgttggcaagagcttaaaagaagcaatctgggcaatcctgatgccagttatcattcttggcggtatttacacaggtatctttacaccaacagaatccgcagcagttgcagttgtatacggcctgatcgtttctatcttcgtatacaaggaaatgactgttgagcgtatcaaacagatcgtaatcgacagcgtaaaaggtactgcaaacattcttcttctgatcatggctgccacactgttcggctatgtacttactgtttacaatgtaccggaactgtttacatcactgatgacatccatgatccacagtaagattacattcctgttattcctgaatgtacttcttatcattcttggtatgctgatggactccggagctatcatccttatcgttgcgcctcttgtttatccaatcgcaatgtcctttggaattgacccggttcatttaggatgtatcatcgtatttaaccttgcagtaggacaggcaacaccaccttttggaaactgtctgtttgcagcaattccggcaaccaagcaggatgtagtaacacttgcaaagaatgtattcccatttgtaattatcctgtttgcaaccgtatttttggtttcttatgttccggcattctcaacattcctgccgaacctgatgaaaggctaaaatatgaaaaagatagacatgatcattcgcaatggacaggtattcgattctgtcaatgcgaagtttgaaaagaaagacatcggtattcaccagggcgtatttgttgccctggatgaagatacccagagtaataacgaagtagatgcagaaggcaattatgtagttccgggtatcattgatgaacatgcacacctgaatttatatggaacgatcatcggagccaatgcagataccgtatgcatcccaaatggcattacaacagcctgcgatggcggaacctgcggagcatcaaactttgaacagttttatatgtccaatattataagatatgaatctactgtttattcttatctgaatgtttctacttttggaaataagagcttatgcaaacacgaagaggatcacgatcctgcagatttcagagaggatctgatcgacagtttgtttgagaaatatcctcaggtgcttcgtggattgaaagttcgtatgtgtaaggaaaccctgggcgaccatggaataagtcctttacacgcaggcatcgagatgagcgagcacctgaaagcaaaaggctatcattgcccggttgccatccattatgatgaccttccggaaaatgtaaccgtaaaagagctgtttggaaccatgcgtaaggacgatgtgatcgcccacgtattccagacaaaggcagaaaccattttcgatgaaaacggaaagatcaaggattgtgtatgggatgctaagaagcgtggcgtttacatggatgactgccatggccgtgttcactggtcctatccaaatcttcagaatgcattttcacagagcttctatccggatatcatcagttccgatctggttcgtgtcagcgagtatacccgtcctggattctcccttctgtatgcaatgtcagtaaacagtgcagcaggaatgccaacagagaaaattttacagagcgtaacctatacccctgcaaaatctcttggcattgaagagaaagcaggtgtgatccgtgaaggtgcaccggcagatgtggcaattctggatatcagagatgtgaaggataaaacctttaccgataattatggaaacagtatttccggcaacaagttgtttgttcctcttatgactgtaaaaggtggaagaacagcatatcgtcagatttttttctaaagagataaacgaacgaggaggaaaatgaaatgagctatcaggtaaaaattccatcctgtgcctttggtggtgtaggaagtatcgaaaaggtcaaggaagttatcaaaaaagaaaaatcacagaaagtggttgtgttttctgatgaaggtatcaaagcaacaggacttcttggaatcctgactgcacggttagatgaggctggtgttcagtatcatgtatttacggattgcaaaccagagcctacatacggacaggtagaggcagttgtagatatggcgcagggacaggaatgcgatctgatcatcggacttggcggcggttctgttatggatgctgcaaagcttgctagtgttctcaagggtgcttcctatacaatcaaggatcttatgaatgatcctacacttgctgagaaaaaagtgaaaactgttatgattcctactacctgcggaaccggatctgaggctacctgcaacgcaatcgtagcggtacctgaggaaaaatccaaaaaaggtatcgtaaatgacaatatgattccggattatgtaattctggatgcacagatgatcgcaaagcttccgaaatcaatcgtagcagctaccggtgttgacgcccttgctcacgtagttgagtgctacacttccaagaaagcaactccattcagtgacccatatgcagtagagggtgcaaaactgattttcagaaacattcgtgaagcatacaataatccggacaacatggaagcaaagaacaatatgcttcttggtgcatactatggcggaatcgctatcacaggaagtggtacaacagcagttcacgctctgtcctatcctctgggcggcaaattccatattgcacacggtgtttccaacgcaatcctgtttgctcacgtaatggaattcaataaagatgcctgccaggatcgtcttgcagcactttgtgacgctgtatatcctacatatgcagagaaatctgttgaggaaaaagcagactacattatttcccagatcgcagacatcgtaaaagtaacaaatatcccaactgacctgacacagtacggtgtaacaatgaatgatcttgatttccttgttacagcaggaagccagcagcagagacttctggtaaacaacatgaaagagcttagtcttgatgacatcagaaacatttatctgaaagttgtaaaataaggaggcatatatgaaaccaatacttggaattacaatgggtgatccatctggaaatggtccggagatttctgtaaaagcattaatgaagccagagacttatgaagtttgcagacctcttattgttggagatgcaaagtgcatggaagcagcaatcccaactgtcaagggtgctgagagcatgaagatcaatgtgatccatggtgtaaaggaagcaaaatttgagccaggaatcattgatgtttatgatctggatgtcgtagatctttccaaacgtctgtataagaaagacagaaagaagctggcagagataatgcaggcagacgttcttgacgcagcatacaaagaaagcatgaccatgtgcggtgaagctgctttccagtatgtaaagaaagctatcgagctggcaatggccggtgaagtagatgccaccgttaccaacgcactgaataaagaccacatcaatatggccggtcatcattactccggacataccgaaatatatgcagactatacacatacagcaaaatactccatgatgcttgcacatgatgagttgcgtgtcatccatgtaagcacacacgtatccctccgtcaggcatgtgatctttgcaagaaggaaagagtcctcgatgttatccgcattgcaaatgaaggttgtaaggcacttggtatcaaggagccgaagatcggtgttgcaggcctgaatccacactgcggtgaaaatggtatgttcggaagagaagaaattgaagaaattcagccggccattgatgaggcacttgcagaaggaatcaacattccggaaaaagcaccaactccgccagatacggtatttagtaaagcacttggcggctggtacgacattgtagttgtaatgtatcacgaccagggacatatcccgctgaaagtaaaaggtttcgtatataataaagagcttaagaaatgggatgcagtagcaggggtaaacgttactcttggactgccgatcatcagaacgtccgttgaccatggtactggcgagggccatgccggtgacggaagtgcaaatgaactgagtcttgtaaacgcaatggattatgcaatccgtatggcaaatgcaaagaaagagaaagaggtagaagcataatgagcagatatgatatgatcaagggaatcatcccgccaattattacaccaatgaatgaggatgagagcttcaacgaggcagagttccgcaaccagatcgagcgtcagatcgagggtggtgttcatggtattttctgctatggtacaaatggtgagtgttatgcattaaatactcaggaaaaagaaaaaatcctgaaggttgctgttgaccagatcaaaggccgtgttccggtttatgcaggaacaggatgcatcacaacaaaagagaccgttgagatgagtaaacgtgctgaggctcttggtgctgatatcctttctgttatcacaccatactttgcagctgtttcccaggacgagttatatgagcactacaagacagttgctgaggcagttaagatcccgattgttctttacaacattcctgcaagaacaggctgctccatcgctcctgagactgtagcaaagctggcagagattgataacatcgttggtgctaaggattcttccggaaactgggataatctgaaagcatacatcgagcttacaagagataaagatttcgctgttatttccggaaatgactctctgatcctttccgcactgaaagaaggcggcgttggtggtatcgcaggatgcgcaaacgtatatccacacaacatggttgctatttatgagaaattcaaagctggtgatctggaaggtgctcaggctgcacaggatgcaattgcatcatttcgtgcctgcttcaaatatggaaacccgaataccatcgtaaagactgcagttggacttcttggatatcctgtaggaaagtgcagaaagccattctacagtatgtctgaggaaggcgtagcagcattaaaggcagttcttgaagagaataagagaaatggaatgaactgataaatgaaattattgatgattgctgacgattttacaggtgcgttggatgcgggcgtacagtttgcaaaaaagggattttccaccaaagtgctggtttattccaaggatatgtcctttcaggcagaagacgcagatgttcttgtggtagatgcggagacacggcataaaaagcctctggaagcctaccttactatatttcggattgtaaagccggcagctgagagcggagtgaagtatctgtttaaaaagacagactccgctctccggggaaacattggcgcagaattgactgctatgctggatgcaacaggaaaatcactgctgagctttgttccagcttttcctcagataaatcgagttacggtaaatggagttcattatattgaggggattccggttgacagaagtgtatttggctctgacccttttgaaccggttacagaagcaaatgtggaaaagctgattcaccagcagtgtgaaacaaatgtgcaaaccatttcagcaggacatacgccagatgcatgtcaggagaaaaccattgccgtgtatgactgtgcatcagatgaggaattaaagggaattgcggattctctgaaaaagacagattctcttggtctgattgccggatgtgcaggtcttgcggaaattttgcctgatgttcttggatggccaaaatccgaaacaacacagcccagacttccggaaaagtttctggtagtatgtggaagtgtaaatccaattacggtcagacagctgaactatgcggagaaacatggatttatccgtatccagctgacgccggaacaaaaactgaatatggaatatttttccgaggaagacggaaaaaaatggttggattggttctgggatatttgcagcaagaactcaaaagtaatcattgatacgaatgacccggaaggtgataatgaaacagagcgttttgctattgcaaacggcatcccgaaatcggaaataccggtgcggattccggcatcacttggatgcatcattggaaatatggtgaaacgtggattgaatagttcgatgttgatgacaggtggggatacccttcttggctgcatcaggaatctgggcaatgctcagcttacacctgtgggcgagtttgaaattggaatcgttctttccaagttaatttcagataataacaaaactcatgttttcacaaaatcaggaggtttcggagaagagacacttctgacagatatggcggataaaatatgtcgtcgggcatgagaaggaggcagaattaattatgaagtatgtaatgacagaagcagttgctccggaagggatggctcttcttgaccagagcgagaaggtttatgttgcacatgacgcaaaccctgcaaactatacagaggaaatgaaggatgcagatgcgctgatcgtacgtgctgctccggcaaagattgtaaacaaagcagttatggaggcagctccacggctgaaggttatcggaagaaccggagttggctatgacagcgtagatgtagatgcagcgacagagcttggtattccggtagttatcacacctggtgcaaacaaccgtgctgttgcagagcattccctgacactgatgctggctctttccaaaaaccttgttgaggcacaggttgaggcttccaagggcaactgggcaatccgtgatgcacataagcagtttgagctttacggaaagaaagccggaatcatcggacttggccgtatcggccgtgacactgcatctctttgcactggtattggtatgaaggttgccggttatgaccctttcctgacaaaagagcagattgaaggaatgggatatgagtactatgcaaattatgaggatcttttgaaggattgtgatgttatttccattcacgttccgctgacaaaggagacagagaacatggtttctgcaaaacagctgaaagagatgaagaatacagctattattatcaactgttccagaggtggaatcattaatgaggcagatctgattgaggctctggacagtggcgagattgctggagctggacttgatgtatttgtaggtgaggagattcatccaggaaatcctcttcttgatgcaaagaatcttattttcagcccgcacagtgcagcacagacaagagaggctgttattaacatggcaacaatgtgtgtagaaggctgcaaggctgtatgcgccggaaagaagtggaagctagttgcaaatccggatgtttataaacatgaaaaatggaaagatgctgagtgggcataaaatttaaatttatctgaaaaaggctatcagccgccggattgaaaagtttggcggctgatggccttttttacttgagaaattttaggtggcatggtatcgtataggtaatgaaaaaagcacgactaatattttaaagagggtagtcatcatgattattgattatgttgacaaaataaatctttatccggagcttcaggaatatgcggacatggttcacggttttatctagagagttgagaaagaaaagcttctggctggcagatatgatctggagaagggcgtatttgcatccttgcagaactataacatcaggccatttgccggtgcacagatggaattccacaagaaatactgtgatctccagtatattgtaagcggaaatgagaaaatttattggctatctctgcggaagctgaccgttgtggatgatcacacagaggacggggattatctgctttatgagtctggagttgaccagggatatactctgatggagaggggaatgtttggattttatgcaccggaggatggacatatgccaagcattgctgtgacagatccggagccggttacgaagatcgtgtttaagattccggtgaagatgtgattgagtaatttatctaaccgaataactgtttaactaatgaaggtgatttgactctgagcaaataagagaagagcggttttaaatggcagaaatgttatttgggactgctttttctttttatgaagaactgtcagattgaaatagtgtgaagaaatcattgcattatgatacttttccgtaatgaaaaattaaagaaaaaggatttctctcatatttccatcaaatttcaatgccattatggatgctggtatgatgtaaagggggagactgtccgaaaactaggatgagtcttcactgaaatttagattgattcactcatatgggtgttcaatataaataaaaaatgtacattgctacgaaaataaaactcgtagcaaaaaactgaaccttgacaacaaatgttttcaacaattatgagagcatcactataaagcagtcacagtattggctgccggaagtaagatattgatcgtatttaagaaaggctagctttgagctttcacatggtagccatgcttttccaattcccgtatataacgagaaagctgtttttgctcacagttcttacgtctggtttcaaaacaagattcgtcaaatagagttccttgctttaacattgtgtagataatgacaaggagttttcgggcaagtgcgacaatggcttttttggctccctttttctgtttgattcgccagtaccatgcagaaagataggtgttgcgttttcctgcaataacccaggcaatctcgcagagcatgctttttatgtaaggattaccttttgtgacagaggtgctttttcgttttccagcgctttcattattacctgagcacagaccagcccatgagcagatatgttccgcagttttaaatggattcatatcaataccgatttcagcaataattgcacaggaagcagttgtgcttattccatagatgctattcaactgctcaacctgcagggcaaatggaggcatatcttcctcgagactcgtttcaatttcagtaagatgtttctttaaagaattgtaatgagtcatgagaattcttaaaaatgccttttggtgttctgacaacgttccgtttacggacatgagaatttcatcaatatgttttctggtcttggttttaagacatgaatctaaagtagttttatcaatctgcccatgttctattaaatgcaaaatgatatttctgccagaagccccgaaaatatcagaaataaaggatgatagacgaaagccggaactttgtaagaatttttcaatcctgttcttttgtgatgtaatatcgcggatgacacttttacggtaacgatttaaatcacggaattcgcgaatccttttttggggaataaaacttccgttcagaagtccggcgcgaagcaaggtagaaatccattcggaatcccgcatatcggtctttttgccaggaacatttttcatatggcgtgcatgcagaagcaagggtgattattggaagacgtgttctttataacgtggataagataaaaaatatcttgatgcaatggcagtgtaatgaaagatgagaagataaaaatacaacaactttccttcggaatgaaaagtaaaaagggaaaatattccggtaaaacaggcaaataaaaattagcattttgcatggctcgtagcgatcacaaattctggttgaatgaaaaagtaacttccaccatacattggcacaggtaaaataagacctttttatgtgctagaatgtatgcgattaaaaaaacgtcgcagagtatgctactctgtgaaaaaattgaggtgttcccgtggagaaaccacagtattactccatcacagttaaaaagatgaacatcctgaccagacattccgactggttagtaaaaacacaggaactgtataaccagatactggaattttattacaacctataccttgacacatttcaggatccagtatttgtaaaaccagcaagaggaagtgcgagtattgctatatctaaggtatatgataaagaaacagtagatctgttatttgcgcatgatgacggattgatgattcaagaatatcttgatggacaggaaataggagccgatgtttatattgacatgatttcaggagaagttgtttctatttttacgaaaaagaaaataaaaatgagagctggagaaactgataaagcggtttcgttcaaaaacgagaaattatttgagttaataagaaaatttgtttccgaagctggatatagaggacagattgatattgatatatttgatattgatggagagtattatatatcggaagtaaatccacgctttggtggtggctatcctcatgcttacgaaagtggttgtgatcacatgaaacttattacaactaatcttgaaggaaaagtcaacaaggtacatattggagagtatgaatcatgtatttacatgatgaagtacaatgagctttatataagaaaagatagttagatgttaaagaaatggtgtacagatgtgaaaaaagaagaaagtaagtgtgaggatgaagatattaattatatgtaattgtgccacagggctagaaatttttcgaggaatgctaatacggaaattggtgaaagaaggaaatgttgtaactgcgattgtaccacaaacaaatgataagaaagaaaaggatgctgaagatggactaaagaaaatgcgttgcaatttaataaggattcccatagagcgccgaggaatgaatccatttcgggatatacagctttttctagaatattataggacagttaaaaaaataaagcctgaattggtgattacatatacaataaaacctaatatttatggtggtttagtatgtcgattattgaaaattccatatgttgctaatattacgggacttggaacagcctttcaaaataagggactgttatgtcatatggttagtgggatgtataagttggctttaaaaaatgcaaaggttgtattttttgaaaatgttgagaatagagatgttattgttaaagcgaagattattccgaaggatcagacatatgtgttggcaggagctggtgtggatcttgaacacttttattatatagaatatccagaagaaacaaatttgacaaaatttttgtttataggaagaattatgcgtgaaaaaggaatagatgaattgttttctgcaatggaacgattaaataatgaaggatataaatgttctttggatgtgttaggaggatttgaggaaaattattctgagaaaatcaaaaaatatgaagaggatggatggctgaattaccaaggatatcagagtgatattagaccatttattgcggaagatcattgttttgtactaccatcatggcatgaggggatggcaaatacaaatttagaatgtgctgctagtggaagaccgataataacctctaatatacatgggtgccttgaggcagttattgaaggaaaaacaggatttcttgtgaaagtaaagaatgcagatgatttatatgaaacaatgaaaaagtttatggaactttcttacgaagaaaaaagaactatgggaattgcaggacgggaacacatggaaaatatttttgataaaaaaaaggtagttgaggaaactataagttatttaaaaaatgagtaagagtatggaagggcttaataatggtaaagataggttatttggtggcaaaagtaaaagaaaaaatttttcataatcatgagatactgtacgattattatcgttgcgtggggggtgaaaataggaaaagattgtttgctttgttcttcaccgatgactagagagccatacttaattaatataggcaataatgtaacagtttctactaacgttacatttgttacacatgataatagtataaaacttttatatcctgagaaatcggatgtttttggaaaaatagttataggaaataattgttttataggtgaaaatgctacaattctttatggtgttactttagctgataatataatcgttgcagcaggatctgttgtaacaaaatcttttaggaattccaacattataattgatggaaatcctgcccatattataaatacatgggataaattttcagaaaagataaaggataatgttataactcgtaaggaaatggaaaattgtaaagaaagagatagttcgtttttaatatctcgataaataggaggatttatgtacccattagtttctgttattataccaacatataatagacctacttatttaaggcgatgtttggaatctgtcttaaatcaaacatataaaaatatagaaatatttgttgtcgatgataataatccagaaactgaagcaagaattgaaactgaaaaaattatgaatgaatatgtaaatggaaaaaatgttacatatctaaaacacaattttaataaaaacggttctgcagcaagaaatactggatggaaacattcatcaggcaaatatataacatttcttgatgatgatgatgaaattgatgaatcaaagattcaaaaacaagttgaatgcttggaaaaactggatgagtcatggggggcttgttatacagcctataaattaataaaggaatacggaagtaatcagatttcaactgaaaatagaagcggtgattgttatgttgatgctttaatgcggactatgtttatggggtctggatcaaatttatttttaaggaaaaaagttgttgacgaaattggtggatatgatgaatcattccaaagaaatcaagatatcgaatttttagttagggttcttgaaaattataagttggcatatgtagatgaagtcttgcttactatttatcaagagggaaatcgagttagtaggtctttcgagcaaatagataaatatgcaaaatattatttagaggtttttcaagataaaataaatgcgttgaataaatcggatagaaatcgtgtgattgctgttatttcattagaaagatgtagagttgcattctataagaaaaaatataaagaaggacttaaaataattttagaaaataatgtcaaatttaaatatatcattagatacataaaatatataatacacagacttataacgcatgaatcatatggatttaatggattgtaaaggagtaaataatgtttggatatgtaatattacattatcagagtattgaaataacaaaaaaatgtgtggataaacttctaatgtttagcaaaactaatccaattgtaatagtggataattgttcgccaaatggaagcggaaaacaacttgaaaaaatgtattcaaaatgtactaacatcacagtaattattaatgaggaaaatcaaggatttgcaaaaggtaataatttaggatatcagtatataaaaagaaaatattcattaagttatgttgttgttatgaataatgatattatgatcgaaaataatgactttgatgtaataattgagcaatttatggaaaaaaatggagtagatgtatgtggacctgatatggttacattaaaaggaaatcatcaaaatccattgcaattaaaaccttgtactagtaaatatttacagcgtcgtgtaagagaggataaaataaaggttcttttgttgagaacaagattgttctggaaattatatgaaaattataaaaaaacacataaaataccaattagaacaaaacaacccactgtgtttgattgtatattacatggttcatgcattatatatggatcagaatatattaagagagaacaaaatgcatttttgcctattacatatatgtataatgaagaagctatattatatgattacttagtacataaaggatataaaacaggatattgttcagatgtaacaattttacacatggaaggtgtttctacttctgagagaattgaaaataagaagaaaaaagttatgtttagatttaagaataatattaaatcgatagaagcccaattgaaagaaagaaaaaagtatattaatcaatctgaattataaaaaaataatttaagaataagagaatgatgcaagttggacgtacaatgagggaagtttctgaattaactatgatttataaattgtctatctggttaacagagttggtagatatagagatcagaatatattaatggaatgacattatatgaaggagaaagaaagtgcttaaaattattgtgaagcgtagaaaagacggaagaatattgacattatcttttgtttttttatttataatattgtggatacttataggatttaattttaaaaatccagattatgaatattacgaaaatttattttcacgtgcaacccaaggagtaagttatcatgcagtggaaactggattttggtatatagtgaaatttgcagcgaagataggggttagctattcattatttttgaaaatttatacgttgattgcacttttattaattagtagttcaataataaaatatacagaaaagccttcattagtattggtgttatatatgtgttatcctttccttttagatgttgctcaaataagacactttatggcaatatctatttttacattttcagtacgatatttagaaagttacagcaagaaaaatttgattaaatatattttcttaatagttattgcagcgtcgcaacagattatggcaattgcatttttggcgtatttattagtatacttaattgatcaaaaaaaggcagcaaagatagcaataatgttaacaattattaatatgtttgggtgcaaatatattttacaaacatcgttggtgcaaaaaatattcagcttacgtgataaaactgttgattatgcaagtgggtatagtaatagtcagctttttatgtatgcgtgtttttacggaatattaataatattatgtgtttttttacagaaaataaataatgtggataaaactaatagatcttttttgtataagatatgtatgtattcaactttatttattccatttttaatgattgattttcaatatacccgcttattcagaggaagtattttagttatatacatttttataacgcagcaaatctattcattaaagaaaagtgataagttaattgttacaataggacttctatttataatgatactggtagcaataaagctatttggaaaaggaagtggttattttgaaacacttacaatgccgatttttcaaaataatgagatattatatttcctttttaactgaatgtaaacagtaaatatggaaaatcgaatttattttaataagcagattgcgttaaaaatatactgataattattttaataattgctaaatatacattttaatgttatacggggagtgtaaaataaattatgaaaaatagaacctttttccttggtgctgatcgagtatattttacttacggaaaccttgtcaaggctgaattttacgtcggtagcctagccaaagttggactaccgacgtaaaatgggagttccaggccaaagaaagagtaggtaaaggctcatagccattgaacttcttgattttattgaggggggagctgattttggatgtataaaattgacagacactaccttatacagatgaaaggatagatatatgaaaaaatcaattaagctaaacggcattttaaatgtaataaaaaaatgttgcaatattatattacctttgcttgtttttccgtatatatcgcgagttttaggacccgataattatgggaaatttagtttttccaattcaataatcagttattttatgttgacggcgttgttaggaatagaaacttatgcggtacgagaaggggcaagaattagaaatgataaacatagaatagataaatttgtctcagaagtattctcaatcaatataatgtcgttgataatttcttatatttttttgctattttttatatttaccaatcaaaaaatatattcttataaagaactgattttgattttgagtattatgattccatgtactgttttaggcagagactatattaatattatatttgaggattacttgtatataactattcgatatatagtgattcagattatgggtgttttggcaatatatttacttgtaaaaaagcaagaagattatttgatatatacgtatatatatatgctaacgaattcactaggatatcttattaacttagtatacactcgtcggttttgtccttttaagttaacaatacatatgaacttgaaacgacatttgctaccaattttaatattatttggtgggcagttagccgtaacaatttatattcaatcagatataacaatgcttggttttttttattctgataaggaagtaggagtttatacaataacatctaagatttacatgttggttaaaggaataataaatgcactaacaacagtagcaatacctaggatatcttattatttaggtgaaaatcaaatagaaaaatatagagaattttcgaataaactaatcaaatacttatttctatttgttgttccgttagtaatagggttacttttctttagtgaaaatattttgcaaataattggaggaagacaatatatttcgggagctaatacattaaaagtactttctttagcattattttgcgcagtgttttcaggatttttttgtaatggactaatggtgccaaacagaaaagaaaaagaattccttgttatcaccacattgtcagcttgtgtaaatattgtccttaatttattttttatacctcaaataggaacgataggtgctgcagtgacaactttaatttcagaagtgattgtattgtttatgtcattttatactatgaaacaatattttaaaatagaatgggattttaagcatataatttctgttatattggctggaattacagtaataatagtgtgtatcttgtgtaagtttttaattaaagatgcaattatccagttaataattgcaatgataatatctgctttggtttattgtggaatattaattattttgaaaaataacattttagtgaatttaatcaacgaggtactaaagaaaaaaactaaataactgataattaataaagaataggaaggtaatataaaatgaaaatagcagtagcaggaacaggatatgtgggattatctattgccacacttttatctcaaaatcatgaggtaatggcagtagatattattccagagaaagttgagaagattaataaaagaatcagtccaatccaggatgagtatattgaaaaatatttaaaggaaaaagaactgaatcttacagccacattagatgccgaattagcatataaggatgcagattttgttgtgattgcagctccaacgaactatgacagcaagaaaaatttctttgatacatcagcagttgaagcggtcattaagctggttattgaatataatccggacgcaattatggttattaaatcaacaattccggtaggttatacagcaagtatcagagaaaaattccactgtgataatattatctttagtccggaatttttacgtgagtcgaaggcattgtatgataatttgtatccatcaagaattattgtaggaacagatattgaaaatgcaaggcttgtaaaagcagcgaatacattcgctggattactgcaggaaggtgctattaaagagaatattgacacgttaattatgggattcacagaagcagaggcagtaaaattatttgcgaatacctatctggcactcagagtttcttattttaatgaactggatacttatgcagagatgaaaggacttaatacacagcagattattaatggtgtgtgccttgatcctagaattggttcccattataataatccgtcatttggctatggtggatattgcttgccgaaggatacaaagcagcttttggcaaactatgaagatgttccgcagaacatgatgtctgcaatcgttgaatctaacagaaccagaaaagactttattgcagatcgggttcttcagaaagctggatactatgcatatggagacgagaatacctatgatgcttctctggagaaagaagtagtaatcggagtataccgtcttaccatgaaatctaattcagataacttccgtcagtcctctatacagggagttatgaagagaatcaaagctaaaggggcatctgtgattatttatgaaccaacattggaagatggaagcactttctttggaagcaaggttgtgaatgatctggacaaatttaaagaacagagccaggcaattatcgcaaatagatatgatagttgtttggatgatgtacaggataaagtatatacaagggatatttttaaaagagattaaaaatgtaataaggggagaatattaataaagatattctcaaataaaggagaatacagtttttatgtgtggaatagttggttttactggaacacagcaggcagcacctattttattaagcggtctgtctaaattagagtaccgaggatatgactcagcggggatcgctgttcgtgatggtgataagctggcggaggttgtaaaggcaaagggacgtcttggaaatctggctgaaaaaacggatgagggcagagctctgcgtggtacctgtggaattgggcatacacgctgggcaacgcatggtgagccagccagatcaatgcgcatcctcatgtttctggtaattgtacgcgttctggttccggtgaagtggaatccgaagtggtcggagtacataatggaatcattgagaattatgcggagttgaaagacaagctgttaaagcatggctatactttttatagtgagactgatacagaagttgtgataaagctggtggattattattacagaaagtataatcttggtccggtggatgcaatcgcaaagaccatggtgcgtgtccgtggttcttatgcgctggagctgatgttccgggattatccgggtgagatttgggtggcacgaaaggacagtccaatgatcattggtattacagatggagagacttatgtggcttcggatgtgccggcaatcctcaaatacaccagacaggtttattatattggaaatctggagtttgccagactgacaccgggcgaggcacatttctacaatctcaatggtgaagaaatcgagaaacagacgactcagatcaaatgggatgcggaagcggctgagaaggcaggctttgagcattttatgatgaaagagatccatgagcagcctaaggctattcaggatactctgaattctgttattaaagatggagccattgacttttcagggctggaattaacaaaggaggaaatcctgagttttgagcagatttatattgtggcctgcggatcagcatggcatgtaggtatggccgcacaatatgtcctggaggatatggcgcgaattccagtgagagtggagctggcttcggaattccgttacagatcgatggcggtaaacaagaacgcacttgttattgcaatcagccagtccggcgagacggcagatacgctggcagcacttcgtcttgcaaaggaaaagggaatggcaactttggcaatcgtgaatgtggtcggaagcagtattgcacgtgaagcggacaaggtgttctacacacttgcaggtccggagatttcagtggcaacaacaaaagcctacagtgcacagcttgctgcaatgtattgtattgcagtagaatttgcatttgtaagaggcaagattacggaagagcagtatgcatattatatttcagaactgctcacaattgctccgaagatcaataagatactggaagacaaagagagactgcagtggtttgcagctaaatatgccggtgcgcatgatgtgttctttgtcggaaggggaattgattatgcggtttctctggagggcagtctgaaattaaaggagatttcctatattcattcagaggcatatgctgcgggagaactgaagcatggaacaatcagtctgatcgagccggggacactggtgatcggtgtgttgacacagagtaagctgtatgagaagaccatgagtaatatggttgagtgccgaagccgtggcgcatatctgctgggcctgacaacttatgggaaatatgagattgaagagacagtggattttgccgtatatgtgccgcgaatcgatgagtactttgccggaagcctggcagtggttccgctgcagctgctcggatattacgtaagcgtggcaaaaggactggatgtagataagccgagaaatctcgccaagagcgtgacggtggaataaacaaacaaaaaatgcctcaagttcacatattagtgtttcatctgggagaaaaaatagttattctgcgctggggtatcaacttgctatttgggatgttagatgttaaaatcaaagcacaacaggcatgactcatcatgccgccaaagaaaggagcgtgctgcataatgggaatgtttgttaatccagacaattctgcgttccaggttgctttgaattccgaaatatatatagataaaagcggtctcattaattatacaaataaggtgttaaatacgctgcaaggctatatttgcaatagtcgtccaagaagatttgggaagtctgttacagccaatatgctgacagcttattacagcagaggttgcgattcagaaggattgtttgctgatcttgaaattagcaagagcgcagatttcaagaagtatctaaaccagtttgatgtaattcatcttgatattcaatggtgcatggaaccagcggggggagcagatcaggtagttccgtatatttctgagaaaacgatcgcagagcttaaggagtactatccagatgctctttcagaggatgctaaatccctgccagaagctttatcacagatcaacgctttgacagggaaaaagtttattgtcattattgatgaatgggatgttcttattcgtgataaagccactaatacaaaggcgcaggaagactatatcaacttccttagaggaatgttcaaaggaacagaaccaacaaagtatatccagcttgcatatctgactggcatccttccaatcaaaaaggaaaaaacgcagtctgcactgaataattttgacgaatttacaatgctgagtgcaagcagacttgctccatatattggctttactgaaaatgaggtacagaaactggcgaaggagtatcagcaagattttgatgaggtgaagcggtggtatgacggctatctcctgaatgaatatcaagtttataatcccagagcagttgtcagtgtgatgctccgaggagaattcaaaagttattggtcagaaactgcttcttatgatgcaatcgtgccactgattaatatggattttgatggacttaaaacagccatcatcgagatgctgtcgggtgcagaagtcaaggtgaacacagcgacattcaagaatgatacacttaatataaaaagcagggacgatgtgttgacttatatgattcatctgggttattttgggtacaatcaaaaattgaagactgcttttgttcccaatgaagagattcgccaggaactcactgctgcagttgaaagtagaggatggaatgagatgctggccttccagcaagattcagaacatctgcttgatgcaacactggacatggatggaatggcagtcgctgcacaaattggaaaaatccataatgagtatgtgtcggtaatccagtatcataatgaaaattcgctgagcagtgtattgacgcttgcatacttgagtgcaatgcagtattattttaagccgattcgggaattgccaacaggtcgaggatttgctgattttgtattcatacctaagccagaatatagcgcatcttatccggcaatggttgttgaattgaagtggaataaggattctgcaaccgctttgcagcaaataaaagataagcagtatcctgagtcaatcctgaattatacgggtgacattttgcttgtgggtatcaactatgataagggtaccaaagaacaccaatgtatgattgagaaatacgagaaggactgacttttattattaattgtgaatattcacatggatgtagataagccacgaaatctcgccaagagcgtgacggtggaataaacaattgctttacggaaaaatggtttcatgatatcattaattttacatattagtggtttcatggaacctttttctattaggctttggggaggtgctagcatgacagatcgtaagaagctgccaatcggaatagacatttttgaaaaactggatcgatcggaattctactatattgataagaccgggatgattgaagaactgctacagaatcgaagtgaagtaaatctgtttactcgcccaaggcgtttcggcaaatccctgaatatgagcatgttgaagaccttctttgagataggaagtaatcctgccctgtttgatggtctgaagatttctgagaacaaagaaatctgtacaaagtatatggggcagtttccggtgatttctatcagtctgaaaagtgtggagggattatcctttcaggcggcctgtggtgcactgaagacagttataggaacagaggcgttgaggttttcgtttttggaagaaagctctgctttatctgatgcggataagaaactctacagacagcttatcgaaattggaacatcggaaaatggtctgtttgttatgactacggaagcgcttgtttcgagccttaagattttatcatcattgttgggcaggcattatggcaggcaggttattcttttgatcgatgaatatgatgtgcctttggacaaagcttttcagtatggatattatgatgagatggtgtctttgatcagaagtatcttcggcaatgcattgaagacaaatccggatctttatttcgctgttttgacagggtgcctgagaatttctaaagaaagtatttttacaggcttaaataatttgaaggttctgaccctcacagatgtcaggttcgatgaatattttggcttcacagatgcagaagtaagagacatgcttgcgtattatgatctgtctggacgatatgaagaagttaaagagtggtatgatggctaccggtttggaaatgtagaagtatattgtccgtgggatgtgatcaattactgtgatctgttaaaagcagattccgaggcgcatccacaggattactggtcaaatacgagcggaaatgccatggtgcgcaggtttattgacaaagcggatacgcgaacaagaaatgagatcgagaagctgatttccggtgaagaaatcgtgaaagaaattcgacaggaactgacatacagtgagctggacagcagtattgagaatctatggagtgtgctttttacgactggttatctgacgcagagaggacaggttggcacagatacatttaaactggctattccgaatctggaaatccgcaggctgtttatcaaacagattcgggagtggtttagagaaacttcccaaagtgacggagagactctgaatgagttttgtaatgcttttccaaggcagaatcctaagaagattgaagaactgtttggtgattatctctggaatacgatcagtatccgagatacagctcccgcaaaaaaagagaatttttatcatggaattcttctggggcttcttggttataagtctaattggctgatcaaatccaatgcggagtccggaattggatacagtgacattctggtggaggtgccggataaccgtaccggaatagtgattgagctgaaatatgccgagaacggaaatatggataccgcctgcgaggaagcactgaagcagatcgaggacagggattacactgccagactccgggacgatggcatgcgtaatattattaaatatggaattgcctgttacaaaaagaattgcaaggtggtattgggataatcatttgaagacatcacagtcggacaggaggaattttcatgagtagattaaacaatctttgcagcatgatgattgagttttacagagatgacccggcgagaatccagcactttataaaggtgcacagctttgctaagctgatcggggaagaagagcatctggatgagaagctgctctatattctggaagcggcagcttatgtacatgatattggaatccgcccggcggaggctaaatttggcagatgtgacggcaaactgcaggagcaggaaggtccggcagaggcagagaaaatgctgaagaaccttgggtttgatcaggatgtgatcgacagggtatcctatcttgttggacaccatcatacatacacggatattgatggaatggattatcagattcttgtggaggctgattttctggtgaattattttgaagatcacctggagacggaatcgattaaaaagagtgtgaagaaaatctttaagacggagaccggaatccggattgcaacggaaatgttcttcccggaagaattccagatatcagatacctgggcataggatggtctccaggaactggatgattttatcgaatcccagggaatttatattcgtcagtgaataagtggcatagtcgggggatttgacccgacatcatataaaatgatcctaaggcattgtagttggaactctccggtatccggggagtttttctattgtataattctgggatttagtctataatatactagcattattgggagtttgtagtcaatataattcaaggagaggacttattattatgagagctgaagttgtggctatgacgggtgaaaacctggatatggatgccataaaaaaggcaggagacattttgaaagcgggtggactggtcgcgtttcctaccgagactgtatatggacttggtggaaatgcactggatccgcaggcttccatgaaaatatacgcagcgaaaggaagaccgtcagacaatccgctgatcgtacatatcgcagagctggagcagttagagaagattacgacagagatacctgagggagcaaagagccttgctgagaaatactggccggggccgcttaccatgatcctcccgaaagcggatatcgtgccgcgagagactaccggtggtctggacagtgttgcggttcgttttccgagtgacaggatcgcacaggaactgataaaggccggtggtggttttgtggcagcaccgagtgccaatacgtcaggcagaccaagtccgacgatggcagaacatgtggaagaagatcttggcgatgccattgatatgatcattgatggtggacaggtgggaatcgggttggaatccacaatcgttgacttcacggaggaggttccagtcgttctgcgtccgggctatatttcactggaaatgcttcaggagacactcggagatgtacggatggataagggacttctgatcacagacagcagtgtacatccgaaagcaccgggaatgaaatatcgtcattatgcgcctaaagcagatctttctattatagaaggaaatgaagaggacgttgttgcatgcatcaatcacctgacggacgaagcagttgcaaaaggccttaaggtcggtgtcattgcaacagatgaaacgaaggcgcgttatgcgcatgcggatgttcttagcatcggcagcagagaagaagaggaaacgatcgctcatcatctgtacgaggttttacgagacttcgatgatgacatagtggatgttatttattcagaagcgttttacacgccaaagatgggccaggcgattatgaatcgtcttttaaaggcggccggacataaaatcataaatgcacaggaggaaaataaatgatagcattaggatgtgaccatggcggttatgaactgaaacaggagattattaaatatttagaggaaaacaatatcgaatataaagatttcggatgtgacagtacagattctacggattatccgatctatgccaaaagagtagccattgcgattcagaatggtgactgtgaaaaaggtattctgatctgtggaacaggcatcggtatttctatcacagcaaataaattcaaaggtattcgtgcagctctttgttccgactgcttcagtgcagaggcaacaagacttcataacaatgccaatattcttgcaatgggcggcagagtagtcggacctggactggcagtcaagatcgtggatacattcctgaatacaccgttctcagaggaagaacgtcatatccgcagaatcaaacagatcgaagaggatacagatatcacagacgcttatccggaaatctaaaaacaggggaggttcttacggtggctgtacatatcaaaaaacgtgaggattatatttcctgggacgagtattttatgggagtggcaatgctctccggaatgcgttccaaggatccgaattcacaggtgggtgcctgtattgtcagcaatgataacaagattctttccatgggttataatggatttccaaagggctgctcagatgatgaatttccgtgggcacgtgaaggagatccgcttgacaccaagtatctgtatgtgactcacagtgagctgaatgcaatcctgaattaccggggtggaagtctggaaggtgcaaagctctatgtttcgctttttccgtgcaatgaatgtgccaaggcaatcattcaggcggggatcaaaacggttgtatatgactgtgacaaatacgaacacacaccgtctgtcattgcatccaaaaggatgctggatgcagcgggggtaagatattacaaatataatcggacaggaagggaaatcaaactttctgtgtaaaaatggtgaaaaaatgattccagggcgtttactttggggttgacactcggattatttttatttaaaataagataagttcggatgaattaagagttatccggcttattttaataagtttatgagcgatgaagagaatagtacatgaggagcaatctcagagagggatccatatggtgtgaggattctgtgcgtgaatcatggaaccggcctctgagctccatgtgattgaagcatggcgtgtttcctgcgttaaaggatctagagagagcagttcctttgggaattgttaattagggtggtaccgccgaagtccttcggtccctttaccgggatctgaagggctttttttgatgctttttatcccggcatgtatctggtcggaggtttttaattccggcatcatcatatcaaaaaggagaaaagaacgatggcaaagaaattagttgaagcgatcacttccatggaagacgattttgcacagtggtatacagacgttgtcaaaaaagcggaactgtgcggctacacaagtgtaaaaggatgcatggcaatcaaaccggcaggttatgcgatttgggaaaatatccagcatgaactggaccgcagattcaaagaaacaggtgtgcagaatgtgtacatgccgatgtttattccggaatctcttctgcagaaagaaaaagatcacgtagaaggatttgcaccggaagtagcgtgggtaacacatggtggactgaatgaactgcaggagcgtctctgcgttcgtccgacttctgagactctgttctgcgatttttatcagaaagacatccagtcccacagagatctgccgaaggtctataatcagtggtgttctgtagtacgttgggaaaagacaacccgtccgttccttcgttccagagaattcctgtggcaggagggacatactgctcacgcaacagcagaagaagcagaagaaagaacgatccagatgctgaatctgtatgctgatttctgcgaagaagttctggcaattccggtaatcaaaggtcagaaaacagacaaagaaaaatttgcaggtgcagtagcaacttacacaattgaatctctgatgcacgatggaaaagcacttcagtccggtaccagccataactttggtgacggatttgcaaaagcattcggcatccagtacacagacaaagataacacactgaaatatgtgcatcagacatcctggggtatgacaacacgtatgatcggtgcaatcatcatggttcatggtgataacagtggacttgttctgcctccgagaattgctccgacacaggctgttatcattccgattcagcagcgtaaagagggtgttctggaaaaggcagatgaactgtttgcagcactcaaggcagctggcatccgtgttaaagttgatgacacagacagaagcccgggattcaaatttgctgagcaggaaatgagaggaattccggttcgtatcgaatgtggcccgaaagatatcgagaacggacaggctgttatctgtcgtcgtgatacaagagaaaaatatgtggtttctttcgaagagcttgcagccaaagtacaggaagttctggataccatgcagaaagatatgctggagcgcgcacgtgcacatcgtgatgcacacacatatgttgcaacgaattatgaagaattcaaagataccatcaacaacaaacctggctttgtaaaagctatgtggtgcggaaaccgtgaatgcgaagacaagatcaaagaagatgttcaggcaacatccagatgtatgccgtttgaacaggaacacttgagcgatgtctgcgtatgctgcggaaaaccggctaagaagatggtttactggggaagagcatactaatatgaaattaacgattccttccaatgcggaaaaaatactgcacattttagaggaaaacggttatgaggcttatgttgtcggtggatgcgtcagagattctattctgggacgcaaccccaatgactgggatatcaccacatctgcttctccgcagcaggtgaaggaactgttccagcgcacggtggataccggattgcagcatggaacagtgaccgtattaatggataaagaaggctatgaagtaacgacgtatcgtgtggatggagattacgaagatggacgccatccaaagcaggtcatgtttacttcaagtctggaagaagatctgaaacgaagagattttacgatcaatgcaatggcatatcatccggaaagaggtcttgtagatctttttcatggaatggaagatatggagcataaaatcgtacgctgtgtcggtgatccgatggagcgttttcatgaagatgcacttcggatcctgcgtgcagtgcgcttttccgcacagttgggatttacaattgaggaaaaaacaaaggctggtattcaggcactggcaccgaatctgaaatgtgtcagtgcagagcgaatccagacagagctggtgaagcttctggtgtcaccacatccggattatctccgagtggcttatgaaaccggaattaccagagaatttctaccggagtttgatgcatgtatggagactgaacagaatacgccgcatcattgttatacagtaggagaacatattcttcacagtctgcttctggtgcggccggacaaagtccttcggctgacgatgctacttcatgatattgcgaagccagtgatgcgaaagaccgatgaaaatgggcgtgatcatttcaagatgcatgcaccggaaggtgaaaaaatggccaaaagcattcttcgccggctgaaatttgacaacgatacgatcagtaaagtctccagactgatcaaatatcatgacgaccgcccgatgccggaaatgcgttcggtaagacgtgcggtgaaccggatcggagaagatctgtttccgatgtatctcgaagtacaggaggcggatatgcttgcccagagtgagtatcgccgagaggaaaaatctgcccgactgaaaggggtggcagagtgttatcataaggtggtagaggagaaacaatgcgtttcgttaaagacacttgccgtgacaggaagagatttgatccaggccggatataagccaggaccggaactcggagaggtgttgaaggagatgctggaacatgtgctcgaagaaccttccgataatacaaaagagaagttaatggaatttataaaagaaaaacattagaagtatatggaccgtacatttgtatatcgagattccgcaaggagagatatgggaatattttaatggaccatacatttgtatatcggattttcaacaggcttcggaatgggagttatctaagatataacctgactgcgaaaagcattcataaaaattgcaaactcgcctgaaggctcagacagagcaatttttattcataaggcagccagaacatatctaagaaaactcgacattcctgcagaaagttgaaaatcctgatatacaaatcgtatggtctttttttaatttgcatttcaatctatgttggaatagcgggactgatatacgaatgtacggtcgtttattacgtattatattttttataaattccgcccgggaagggcaaggactggatcgtgcgtatgacactaaaatcaaatagcaccgcaggcgcgagcagggaatcacgtccgtgcacagaaaatgtataggcaggaaagattctgacttagatatagatgttagatattttaaattcacaggaagaggagaaaatcggcactgaattgctttttctgcaggagcctttgggagtccttggtcatgttctgactgtgttatcacacccaaatgcattgtctgagcatcgcgagttatacatttgggtgtgatgcttttaacaggcaggttatggcctagtacttccaggcgacgaagccttagcaaatttagtgccgattgttcttccttccgttaatatttgataacgaatctcctttataacagaatctattacttcccaatacattttctggattcccattacataagatagaaggtacaaaatcaagagggggatttttatttgtatgattatggactcagcacactggagcagtatggcctcaccgccgaatctacagcccggacacgtggcggacttctgtgccatacagaaaaaggacttgtcatcgtaaaagaattcaaaggaacagaaaaaaaactacagaaacaacaggaattgcttctgcagatccagagtcagggcggcaaggtggactgctatattccaaatcaggaagaaaacctggtcagccgcgaccgtgacggcattccatatacaatgcagtactggtatgagggcagagaatgcgatacacgttccaaagaagacattttcaaaagtattcgaaccatggcagaactgcatcagcgcatgcatataccgactgtagaatattatatagaaccgtcattggaaaatggatatctgcggcataatcaggaattaaaaaaaatccgcagttttatcagaaaacggggagcatccagtccttttgaaaaaatatatctggcaacagtagaagatttcctgagagacggagaagaggcgtatgcggcattaagagagtctggttatcaggagctacgtcggaaagcagaaacggagggtgaagtctgccacggagaatataaccagcataatgttttgatcttaaaaagtggaactgcagttacaaactttgaacattggggatttgatacgcagatggctgatctgtatcgcttcatgagaaagattctcgagaaatataactgggatgtccgctttggaaaagaaatgctgaaagcatatcatgagataaaacccgtgagcaaagaagaatggataaatcttaagattcgattcagttatcctgaaaaatactggaaacttgcaaattattattatacgcatcgcaaaacctggatttctgtgaaaaatacagaaaaactacaaaatctgatacgacagcgggaggcgtggaaacgatattgtgcttcctttttcttctgaagaggtgtataatatagaactatcaaagacagtagtgaaactgtcggaaatacattgtacagggaggtattttagtatggattacaaagaggtttatgagcagtggattgcaaacccatacttcgacgaagcaacaaaagaggaattgaaaagtattgcagaggatgaaaatgagataaaagaacgtttttatatggatctggagtttggtacagctggtcttcgtggaatcattggagccggaaccaatcgtatgaacatctatgttgtcagaagagcaacacaggggcttgcaaattatatcgcaaaagtagacaagaaatcccagggtgttgcaatcgcatatgattcccgccatatgtcaccggaatttgcacaggaagcagctctttgtcttgcagcaaacggaattaaagcgtatatctttgagacattaagacctacaccggagctttctttcgcggtacgtcatctgggatgtgttgccggtatcaatgtaactgcaagccataacccaccggaatacaatggatacaaagtatactgggaggacggtgcacagatcacaccgccacatgacagcggaatcatgggagaagttaaggcaatttccgattggaatactgttaagactatggacaaggctgaagctgaaaaagcaggccttttcgaggtgatcggcaaagaagtggacgatgcatacatggcagaactgaagaaacaggttattcatatggatgctatccaggcagaaggaaagaatctgaagatcgtgtacacaccacttcatggaactggtaacattcctgcaagaagaatcctcaaagaacttggatttgagaacgtttatgttgtcaaagaacaggaacttccggatggagatttcccaacagtaagttatccgaatccggaagcagcagaagcttttgaacttggtctgaaacttgcaaaagaagtagatgcagatcttgttcttgcaacagatccggatgcagaccgtcttggcgttcgtgtcaaagacaaaaacggagaatatcatgacctgacaggaaacatgtccggatgccttcttgcaaactatgagatcagccagcgcaaagccgtaaacggaagccttccggaggacggtgcactgatcaagacaattgttacaaccaatcttgcagatgcaatcgccaaggggtatggtgtaaaactgatcgaggtccttacaggatttaagtttatcggacagcagatccttggatttgaaaagagcggaaaaggatcttatctctttggatttgaagagagctatggctgcctgatcggtacatatgcacgagataaggatgcaatcgttgcaacaatggcactttgcgaagcggcagcatattataagacgcagggtaagactctgtgggatgcaatgatcgagatgtatgaacagtttggatattacaaagacgatatcaaagctgtaactatgaaaggtattgaaggcctgcagaagattcaggatatcatgaattcacttcgccagaatccgccggcagaatttgcaggacacaaagtggttgctgtaagagattacaaagcagacacgatcaaaaatctggaaacaggcgaagttacaccgacaggacttccgaattccaatgtcctttattatgaactgacaaatgatgcctgggtatgtgttcgtccgtctggtacagaaccaaaagttaagttctactacggagtaaaaggtacatctctggcagatgcggatgaaaaatcagcagtcatgggcaaagctgttctggatatggttgactccatgatgtaaacttgcatatgcgggaatttgatgattttatggaaattgtcaggaaaatacgccgaaattgtccgtgggacagtgtgcagacgcatgaaagcctgaaaaaatatctgctggaagaaagcaatgaggtactggaaggaatcgaccgtctttcaaaagaaaatgacagcacaaatctttgtgaggaactgggagatgtgctgtttcaggtggctcttcacagtgtgatcgcggaagaagagggactttttaccgttgaggatgtgatccgagacgtttcatccaaaatgaaattccggcatccgaagatcttttcaccggaggataaacagctggccgggctttcgtgggaagagttgaaacaattggaaaaagcgacagaagaagagcctgaaaaagccgaaaagccttgacaatttgacataaaaggtttatatatagtaaatagcgtgcatatgccaaggaagcattacgcaataaataagaatgaggttatttagaggaggaacaccatgaataaaacagaattagtagcagcaatggcgaaagaaacaaacctttccaaaaaagatgtagaggctgtattaaaatctttcactgatgttgtagcatccgaattaaaaaaaggtggaaaaatccagttagttggttttggtacatttgaagtaagtgaaagagcagcaagagaaggaagaaatcctcagactggtgaaacaatgaagatcgcagcttccaaagctccgaaattcaaagctggtaaagctctgaaagatatggtaaacgaataagtaaatcgtgcttttaggggggacagatatgttcccccttttgtttatccggaggtatatatgagacttgataaatatttaaaaatctcacgtctgatcaagagaagaacggttgcgaacgaggcatgtgatgccggacgagtgctggtcaatgaccgcccggccaaggcgtcagcacaggtaaaagccggtgatacgattgaaatccagtttggaagcaaaaacgtaaaggttgaggtgctggatatcaaagaaacggttcgtaaagaagacgcagagaatctttttcgctatctttgatcgtttttgtgtctattggacagggctctcacatagattaacagtaaatgcaggatgggagctgtggggttggaagaaaaaaagacaggcaaggtgcacggtctgacgctaaaagagcgtaaatatggaaaactgacaggtgttcaggatattcattcgtttaatgaaaatgagatattgcttcagactgaggccgggaaagtgcagatcaaaggagagcagcttcatgtaaaaagccttgaccttgaaaagggagaggctgagattgaaggaaaagtaaacagtgtttcttatctgacaaagaatgcgcagaaaaaagaagaacctttgctgaaaaggatgttccggtaagatgagcagttatatcagattggaaatactgcttttttttcgcgctttcgaaacaggagtagggatgcttgttgtttacaggctgaccgatatgctgaaaagacgtttgttctgcgacagaatgtggaacagtacagtggatattttgtactggttattggctggtttgctgctttttaccgatttatatcagtgcaattatggcagaatccgcttttttatgctggcaggtgttgcttttggtggaatttttgcaaattttgtgttaaataggttgctatttctggtaaaaagatgtaaaatttcatcatatagacatacgaaaagacgtttatggtgtaatagaaggggcagacgctttgaaaaagtcaaaaaagaaaaaaaataaaaaaagaatagcgaataactaccttggaatggcagcaattgctattgttgttctgcttctgttgggtggactgacttatcagagtcagacacttaaggcgaggattgctgtatacgatgcaaaggcagcagcgctagaagattctattgcaggtgagcaggaacgtacacaggaaatagatgaacagaaagagtacatgcagacggatgaatatatagccgaagttgccagagataagcttggtctggtcaaaggaaatgagatcgtatttgaagaagagaaataaaggagattttgcagaaaagttttctggaacaatctcctttatttgacagatattttaaaagaaccctcttataatatttttctagtgaaagtattgtaatacttaccgggaagtatcaggggagggggatatatgcaggaatggataattgccatgctcgtgatcagcgtactgctgatattgcgggacatggcaaaaactattttgacggggagaatgtcgaaaaaagaagaaatatttccgattggagaaaatcatcctcagaaagaaaaagtggaacgctatgcggcagcttttcagaaacttgcggatacattttatggaatgccgtacaaaaaggaatacctgagtagtgggcagattgagcgtattctgacggatgcgaatgatcgtctgtgcagtaactgctatcatcgggaaatctgctggggaagtcaggcagaaacaatgtgtcaggggggagaagcactggtacgtgctctcgaaaaagatgatgaaggagaacttgagaaacttcgtatgcaatgggggagcgtatgcggaaaatcattgcaatatctggaagaagtacgcgaacagtttcgacaggaaaaacagaatcttatatggatgaatcgtatgatcgaaagtcggctggcagtggctcagcagctgacggagacagcggccattatggagacggtagcaaatgatctgtatgatatttcggcagcagaaccggaatttcaggaagaactgaaaaagaatctgcgaagaaaacatgtgattttgaaagctgcgtgggtgatggacaaagttgaagggcgcagacagatttttcttactctgcgtgccaggagcggacagtgtgtttctgtaacagaagtcgcacagatgctctcagagttatgcgaaagtaatatgacgtctgtgcagggaagccggtgtattgtaaatggggaatttcatacgattcattttgtagaagatgtcagttatcagatgttatacggagtatccagacttacaagagaaaatgaaaaagtatcaggggataattatatctgcagacaggaagacggtggaagatttgtgatgtgtctgtctgatggaatgggatcgggtatggacgcatgcagagaaagtgagattgtagtggaacttctggaacagtttctggattccggcttttctcaggagactgcggcacgtatggtaaattctgcgcttgttctgaaaggcagggaaggaatgttctctacggtagatatctgtgcagtagatctctatacgggaatctgtgagttcctaaaagcaggtgcagcttcgacatttatcaaacgtgaccactgggtggaagctatttcatcagaaagccttgcggcgggactggtacagaggattgattttgacacggcatccagaaaattgtatcatggagattatctgatcatgatgaccgatggtgtgatggacgcgctgcctgttgaatgtgaggaagagacgatgaaagagatcattatggatattcaggatgaaacacccagagagatcagccgggggattttggaacgggcactcgggtacagcgattatcatgcgagggatgatatgacggtccttgtagcgaatgtggtaagaaaataaaaacacaggagaaaagaagatgtataaagatacattgcagaaagtaaaaaaatttatgactgaaacaggaatgctgcaaaattgttcagagatcatccttggtgtttctggcggtccggattcgatgacaatgcttcatatattgaatgaactcagagatgaatttgactatcgtctccgcgtagtacatgtaaatcacggaatccgtggaaaagaagctctgcgggatcagcagatggtggagaaaatatgcagtgaatggaagatcccgtgtgcagtatataattatgatgttcctgctctggctctcagttggaagatgggaaccgaagaagccggccgcaaagtgcgtcgaattgcttttgaaaaagagaaagaaaatgcagtggcgataccggaaaaggtgcgtgtggcgcttgcacataaccaaaatgatatggcggaaactatgctgcatcacctggccaggggaaccgggattaggggcctctgctcactgaagccgctgaacagagaaattatccggcctcttttgtgtttagaacggagtgaaatcgtcaattatgtagaggagaacagcattcagacagttctggacagcagcaatatggaagatgattatacgagaaaccgtatacgacgtcacattctgccactcattgagcaggaagtaaatccaagggcagttacacatatggcagaagcgtcagaaatattcggacaggcagaagcctattttacgaagctggcaggagaaatggcagcaggatacaggaaagcaaaagacagatatgtcctgaatcatgagtttttcaaaaaagaaacaattatccagacatatgtgatcagggagatattagaagtaacaggcggacatcagagtgaccttacctctggtcatataaaacagatcagagatctgtatggtatgcagactggacgaaaagcagatcttccatatgaactggaggcgtccagagtttatgaaggagtacagatccgaaagaaaaatatgatcgcagaatcagatagtgagacagaagaactgaaaatccaaaatcttgttgttccgggagaaacgaaatggaagcagggatgctttactgcaaaaatttattcatataatggtgagaagattttggaaaaaaagtatacgaaatggtttgattgtgataaaataaattgcgaactaactgtccgcacacgcagaagcggtgactatatggcagtcagtcagagcggcgggcataagaagctgacacgttgtatgatcgatgataaaattccgggtgaactgagagggaaactcccactggttgtcgatggaaatgaagttttgtggatcgtaggcggaagaatcaatgagcgttacaaaatcacttccgaaacaggaagggtattggagatcacataccaaggaggaaacgtacaatgagtgaaaaaatcaaagttttactgagtgaagaagaagtggatgcaagaattaagcagatcgcagcccagatcagcagggattatgcaggaagggaaatacatcttatctgtgttctgaagggtggcgtattctttacctgtgaactggcaaagagaattactgttccggtatcccttgattttatgtcagtatccagctatggtgatgatacaaaatccagtggtgttgtaaaaatcgtaaaagatctggatcagccgctgatcggcaaagatgttctgatcgtggaggatatcattgactcaggaagaactctcagctacctgatcgaaatcctgaagggaagaaatcctaacagcatccgtctgtgcacactgctggacaaaccggaacgcagggtaaaagacgtaaaagtagactactgctgttttaatattccggatgaatttgtagtaggatatggtctggattacgcacagaaatacagaaatcttccgtttatcggggtggttgaattagaaaaccaggattgaaaggagacagcagcaggtgaataaacagtcaggcagaattggcctgtatcttgtattgatcgtgatgttggttgccggatacttttatctgaacaatcaggtagcatcacagagcagttactcaatggaaagtatgaaacaggcagcagaggatggtaagctttcttctgcaaaaatctaccagaacagggaagtgcctaccggttccgttgttgcggatatcgaaggtgaagggaagaaaaaagtatatgtaacagatgttaaagacgcacagaagcttctggaaggctacggcattcatccggaagtggcagatgttccgcaggaaagtgtatttatgacaacattttttccggtacttctcacaggtgggctggtgattttcctgtttcttatgatgaaccgtcagatgtcaggaggcggaggtaatgccaagatgatgaattttggaaagagccgtgcccgaatgatgctgccggatgacaaaaaagttacatttcagaatgtggcaggtcttcaggaagaaaaagaagatctggtcgaggttgttgattttttgaaagctccacagaaatatacaaatgttggagcaaggattccgaaaggagtgatccttgtaggacctcctggaacaggtaagacacttcttgcaaaagcagttgccggagaagcgggagttccgtttttctctatttcaggatctgattttgtagagatgtttgtcggtgtcggcgcatcccgtgtacgtgacctgtttgaagagggcaagaagcatgcaccatgtatcatctttattgatgagattgatgcagttgccagacaacgtggtactggaatgggtggtggacatgatgaaagagagcagactctgaaccagcttctagtagagatggatggtttcggtgtaaatgaaggaattatcgttatggcggctaccaaccgtgtggatatccttgatccggcgattcttcgtcctggccgttttgaccgtaaggttgcagtaggccgcccggatatcaaaggaagggaagaaatcctcagagttcatgcaaaagacaaaccgcttggagaagatgtggatcttgcacagatcgcgcagacaactgccggttttacaggggcagatcttgaaaaccttctgaatgaggctgcgatcatggctgccagatcaggacgcagttatattacacagctggatatcaagcatgcatttatcaaagttggtatcggggcagagaaacgaagcaaagttatttctgagaaagagaagaagatcacagcatatcatgaggccggacatgcgatcttattccatgtacttccggatatggatccagtatatacgatttccattattcctaccggaatgggagccgcaggatataccatgcctcttcctgaaaatgatgacatgtttaataccaaaggcaagatgttgcaggatattacgacacttctgggtggacgtgttgctgaagaaatcatctttggggatattacaacaggtgcgtcaaatgatattaagcgtgcaaccagtacagcacgtgcaatggtcatgcagtatggtatgtctgacaagcttgggctgatcacttacggggatgatggagatgaagtctttatcggacgtgatctggcacataccagaagctacagtgaagaagttgcaaaagagattgacaaagaggttcatgatattattgaccgctgccatgcagatgcaagaaagattatttctcagcatatggatgtccttcataagtgtgcagcacttcttttagagaaggaaaagattcagcgcgatgagtttgaggcactttttacagcgaaaaatgaaatgcctcaagaataagatatacaaagtgcataaaaacaaatactaaattttgtgaagtttgtgcacacttttggagggagtcatggtactataataaccgtaaaaaccccccaatacattatatagtttttgctacaccccataagaagaaataccttctccaaaaaagacagcttatcccgctgtcttttttactgtctaaaaaccccgcagcatcaggcgagaaaatcgtcttttgttgcgtttttttgttactcaccaagctttggacatcgctttctggcgccggtaagtgactgcaaatcgcgaaaaggagaaaatcagatacaatcctagactccagaacttctttacgtcaaaatggattcatgttatcattaatccaatatgtgagtttacctaggggagaaatatgatgttaaaaaaaacgaaaaaaagcaaagaatctgtacagggattcacgctcgtagaattgattattattgtagcaattctaggtgtgttggtggcgattttagcgcctgcctataccaagtatattgagaaaagccgggaggcaacagatctggcaaatgccaaatctgcatataatgaattaatgatgaatgtggctgaaaaggaagaagatccagagcctattagtttcaagttaaaacaaaaacatcccggctggcagagtccacttccaattacagtcgggagtgcttcctttgatggcacaaatacagataactgggttggaacaccgggccgaaacggaacctgtgtagtttcctatgataaaaataaaggtgtgatttttacctggagtggtggaattgatgtggcagtgagaccaacatataatggaaagttggatgaaactttaactacccttaaaaagggatataagcggattggtgatgccaacatgaataataataaggccttcttctctaatcagacattctatattaatggagaacggtatactacccgtgtctattatgcggattcatccgctttcaaagatgcattaataggttatacaccgaagcctgcctcctacgatcaaagtcctttccgtaaagtagagcacgattatgatcattttacacaccagggctttgcatactacacctacggcaaagatggctccatcaatatgtttacctatgtaaacgaaaataaggtctatcagacaactgacgaaggtaagacctggcaggacattacgccaaatgaaaaatgaagaataatagtaactattcagaaggtagtatcccgcaaggggatgaaaagttacgaataataaattgtaacagagaggtatcgcgaagtttatgtttacgattaagacagtcaaaggtgatataaccaaaattacagatgtacaggcaattgtaaatgctgctaataattctcttcttggtggtggcggtgttgatggtgcaatccatcatgctgcaggtccggaacttcttgcagaatgcaggacgcttcatggctgtgaaacaggagaggcaaagataaccagggcatataatctgccatgcgattacgtgattcacacggttggaccgatatggaatggcggaaaaaataatgaagataagcttcttacagattgttattataattcgttaaagcttgcgatggagaatgatattagaacaatcgcatttccatctatatctacgggagtttatcattttccggtagagagagctgctaagattgcggtaaaaacagtttgtagatttctgcaggagaatcctgatagttttgatcttgttgagtgggtgctatttaacgaccaggccgcatccgcatatgaaactgaggtatccttaatataaaagtagactacaacaaagaaaatgagaaatgcagatggcatttccaccacaaaagtagactacaaaccaagaaacctggaaatgcagattacatttccagtgcaatataaataatacagacaaggaagattgacaatgaagcaggaaaacgaagatattgcaagaaaaatgcagtatattctgaatatgagaccagtgtttaacaaggaggctcttttcagtgacggaacaaggtattacagaaatcctactgagccaaagagtggcgaaaaggtaataatcagcttcagaacccagaagaataatgtggatgcggtatatctcgtatccggagatcagaaatataaaatgaaagtatacaaaaccacaaaaggttttgattattatggaacaaagattgtgatgccggaagagatttttcggtatcattttgaaattcagtatggatgggctacatgctattacacggaacagggagtctgttctgagctgcaggagtgggcacagtttgaaatctatccgaattatcatacacctgattgggcaaagggtgcggtgatgtatcagatttttgtggatcgattccgcaatggagatccgtccaacgatgtggaaagcgacgaatatgcatatattggtgaacacagtgaaaaagtgacagattggtccaagactccggcagttatgggagtcagggaattctatggaggagacctgcagggcattattgacaaactggattattttgaagagctgggcgttgaagtgctgtatcttaatccaatcttcgtatcaccaagtaaccacaaatacgactgtcaggattacgattatgtggatccacattacggaaagatcgttgaagactgtgacggactgcttgcaccggaggatcgagataatacacatgccacaaaatatatccggcgtgtgacagataagcgcaatctggaggcaagtaatcagatgtttgcacagcttgtggaagaactgcataaacgtggcatgaagattattctggatggagtattcaaccattgtggatcttttaataagtggatggacagagaaagaatatatgaaggacaggaaggttatgcaccgggagcttatatatctgcagacagtccgtatcgctatttctttgattttcatgatcagaatcgctggccttataatccgacttatgatggatggtggacgcatgatacacttcctaaactgaattatgaaggttcaggagaattgtatgattatgtcctgaaagtggcacagaagtgggtgtctgcgccatataatgtggatggctggagactggatgtggcagcagatctgggacacagcaatgagtttaatcaccagttctggaaagatttccgtaaagcggtcaaggaagcgaatccggaagcactgattcttgcagaacattatggaagtccggaaggatggctgcagggagatgagtgggattctgtcatgaactatgatgcgttcatggagcctgtgacatggttcctgaccggaatggaaaaacacagtgatgaatatagagaggatctttatggaaacagtgatgcgtttatcggagcaatgaagacgcatatgcgctctttgcatatgtcatctcttcacactgcgatgaatgaattgtcaaatcatgatcattccagattccttaccagaacaaatcacagggttggacgtgtttcctatgccggggcacaggcggcgtctgaaaatatcaatacggcgatcatgcgtgaagcgattgccatacagatgacatggccgggagctcctacattgtattatggggatgaggcaggtgtctgcggatttacagatccggataaccggagaacttacccgtgggggcatgaagatatggaacttctgaatttctacaaggtcatgattgcggttcataagaaatacaaaatgctcagaagcggttctctgaaattcctatggaatgattatcagggcctctgttatgcgagattctctcatacggagcagatgatcatcgtactgaacaaccgggatgaaggcagagatgttatgattgaagtctggccggcaggaatcagcggactggaagaaacagtatttacaaggctggtgcaatcttctcaggaagggtatacagaccaccggaaacagattctgtgccaggctggatcgctgaatctgtatctgccaccgtgcagtgtgacagtactgcatcataaagaccagatgtaagattagagagttggtatgctatatgaaagctgcagcgcaaaattcacttgacaggtcagaatgggtatgttacgatatcaatactttcacgtggtagagtggctacgtattaaaagaaaaataatatgtcaagggagatagagagatgaagaaaaaagcagttgcagtagttatgacagcagtaatggcactgggaatggtatctgcagtaagtgtgcaggcaggaatagaagataagactctgatcgttggatttgatgcggaatatccgccatatggatatatggatgagaatggtgaatacacaggatttgacctggaactggcacaggctgtgtgtgatctggaaggttgggagctggagaaaaaaccaatcaactgggattccaaggatatggaactgaattccggatctatcgactgtatctggaatggatttactatgaacggaagagaagatgattatactttctcagagccgtatgtagataacagtcaggtaatcgttgttgcagatgattccggaattgagaagcttacagatcttgccggtaagaccgttggtgtgcaggcagcttccgcagcactggatcttcttcagagtgaggaagaaggcggacagaaagaactggcggatacctttggagcactgaatgaatttgcagattacaatactgcattcacagaactgcaggcaggggcactggatgcactggcaatcgatgtcggagttgccaaatatcagctgaattccagaggagagggattcaagatccttgatgagacactgaatacagaacagtatgcaatcggatttaaaaagggtaatacagaactctgtgatattgtgaatgcagaccttcagaaacttgcagatgatggaacggttgcagaacttgctgagaagtatgaaatcgcagatatggtaacactgaaagcttctgatgatgcatcgacagaggattccaaagatgcaacagatgatgcagaaacagataaaacagaagaaaaataagcaatacataaaatacgaatacagaatgggatgcttcccggttttccgggtggcatccctcttgtaggtttatggaggagagtacatgagttttcaggtaatgttacaacagcttaccacgggatttgggcagacactgctgatcttttttctgacactgttattttccctgccacttggcatggttgtatattttggacgtgtgagcaggttcaagccattaagctggatcgttaaggcgtatatttctattatgcgaggaacaccactgatgctgcagctgctgctatggtattttggaccgttctatctgtggggaatgaatatcggcaattataaatttaccgcgatcattctgggatgttctctgaattatgccgcatattttgcagaaatctatcgttccggaattgagtcgattccggtgggacagtatgaggcagcacagcttctgggatacaataaaagtcagacatttttcaaaatcgtattaccgcaggttgtaaagatcgtgcttccttctgtgacaaatgaagtcattacacttgtcaaagatacctcccttgtttattcggtatcttatattgagatgtttgcgctggcaaaacagatcgcagctgcgcagacaacagttgttccgtttgtgatcgccggggtattctactatatctttaactttgtagttgcctgggttatggaatggtttgaaaagaaactgaattactatcgttaggaggaaatgctttgagtacaagtcttctggaaatgaatcatatcaaaaaagagttcgacggtcttcaggtactgaaagatgtgtcgattcatgtaaatgaaggagaggtcgtttcaattatcggttcctcaggctccggtaaatccacgcttcttcgctgtgcgacactgctgacattgattgatgacggtgaagtaagttatatgggaaataaaacggtctggaccgaaaatggtaaagtctgtctgccgaataaaacaaaactgaaagagattcagtcctgctttggcctggtttttcagaactttaatctgtttccgcattatacggtcatgaaaaatattaccgatgcaccaatccatgtgcagaaaagaaataaagatgaggtttacagagaagcgagagatcttctggcaaagatgggattgtccgataaagaagatgcttatccgtatcagttgtcaggtggacagtgccagcgagttgcgatagcaagagcccttgcactgaatccgaaaatcctgttctttgatgagccgacttccgcacttgatccggaacttaccggagaagttttgagagtaatccgttcactggcggatatccatatcacgatgatgatcgtgacacatgaaatgaactttgctcgggatatttccgacagagttatttttatggataaaggtgtaattgctgtagaaggtactccacaggaagtattttcttcaagtaatgcacgaatcaaagaattccttggtaaatttcatcagggagaggaataaagggattgcttttaatgatgcgatgttatataatttctgcgtaatgataggaaatccgagcaaccgcagttacccctgcggttaatcgagtgagatgataggagtaaatacatgagtacagacagatacgtaagtcccctttcagagcgttatgccagcaaggaaatgcagtacattttttctccggatatgaaatttcgcacttggagaagattgtggatcgctctggctgaaacagaaaaagaacttggcctgaatatcactcaggagcagattgatgaactgaaagctcacaaggatgatatcaactatgatgtggcaaaagaaagagaacgtcaggtacgccatgacgttatgtctcacgtgtatgcatatggcgtacagtgcccgaaagcaaaaggaatcatccatctgggtgcaacatcctgttatgtaggtgacaacacagatatcattgtgatggctgaggctttgaagctggttcagaaaaaactggtgaacgtaattgcagaactgtcaaaatttgcagataaatacaaagaacagccaactcttgcatttacacatttccagccggcacagccgacaacagttggtaaacgtgcaactctctggacacaggaattcctgatggatctggaagatctggaatatgtaatgggcacactgaaacttctgggttccaagggaactaccggaacacaggcaagtttcctggaactgttcgaaggggatcaggagacaatcgacaagattgatccgatgatcgcagaaaagatgggattcaagaactgctatccggtatccggacagacctattcccgcaaagtagatacaagagtcctgaatattcttgcaggtattgcggcaagcgcacataagatgtccaatgatatccgccttctgcagcatctgaaagaagtagaagaaccatttgaaaaatcacagattggttcctctgcgatggcctacaagagaaatccgatgagaagtgagcgtatcgcatctctttccagatatgtaatggtggatgcactgaatccggcaattacttctgcaacacagtggtttgagagaaccctggatgactccgcaaacaaacgactcagtattccggagggattcctggcaatcgatggtatcctggatctgtgcctgaatgttgttgacggactggttgtttatccgaaagtaatcgagaaacatatgatggcagagcttccgtttatggcgacagaaaacatcatgatggatgctgtaaaagccggtggagaccgtcaggaacttcatgagcgcatccgtgaactttctatggaagctggccgtactgtcaaggtagaaggaaaggataacgaccttctggagagaatcgcagcagatccggccttcaatctgacaatcgaggaactgcgcaaatctatggagccgtccagatatgtcggcagagccaaagaacagacggttacatttattgagaagactgtacagccggtgctggatgcacacaaagaaatgctgggtatgacagcagagatcaatgtctgatcgatcatttatttacatctatagaataagaaaaaagatcaaataaaacacgaggaggaaaaagtgttatgatcaaagcagtagttggagcgaactggggagatgaaggtaaaggaaaaattaccgatatgcttgctcaggaagcagatattatcgtaagattccagggaggtgccaatgcaggacatacgatcgtaaatgattatggtaaatttgctctgcatacacttccgtcaggtgtattttataaccatacaacaagtgtgatcggaaatggtgttgcactgaatattccggtattctttaaagaatacaatgaagttgtttccagaggtgttccggctccgaagatcatgatctctgacagagcacagatcgttatgccatatcatattctgtttgaccagtatgaagaagagcgtctgggcggaaaatccttcggatccaccaaatccggtatcgctccgttctattctgacaaatatgcaaagattggtttccaggtaaatgaattgttccatgatgattctctgagagaaaaagtagaacgtgttgttgagacaaagaatattcttcttgagcatctgtatcacaaaccgcttctgaatgcagatgagatttttgcagagctgatgaaatacaaagaaatggttgctccgtatgtaggagatgtttctctgttcctgtggaatgcattaaaagaaggcaaagaaattttgcttgagggtcagctgggatccctcaaagatccggatcatggaatttatccgatggttacatcatcttctacacttgctgcttatggagcaattggtgctggtgtacctccgtatgaaatcaaaaaagtcatcacagtttgcaaagcttactccagtgcagtaggagcaggtgcttttgtttctgaaatcttcggtgaagaagctgatgaacttagaagaagaggcggagacggtggagaatatggcgcaacaacaggacgtccgagacgtatgggctggtttgactgtgttgcttccaaatatggctgccgtatgcagggaactacagatgttgcctttactgtacttgatgtacttggctatctggatgagattccggtatgcacaggatatgagatcgatggcaaggttacaacagaattcccgacaacaggtcttcttgaaaaagcaaaaccggttcttgaagtacttccgggatggaaaacagatatccgtggaatcaagaaatatgaagatcttccggagaactgccgcaaatatatagaattcgtagaaaaacagatcggcttcccgatcacaatgatctccaatggacctggaagaaacgatatcatttacagaaacaaataatcaattataagatcataacgcgccggagctatctccggcgcatttcttaatcattttctgaataaagaggtaagtatgaaaaactggaaaaaatatgctgcgatcataggagtgatcgcattactggcgatcttctgccttccaatgtactttgcgttgaagggagatttttcgcagaaggcgtttatggcatcgttatttactgtgctgtttgtggcggttatgtgctatgtgattttgatgctgtttaaatacctgagtaaaaagaaagaagagaagccagagactggcgggataaaaaatatcatttttgatgttggacaggtgctggtggattatgactgggaaacatatctggacagctttggatttgaaccggccaaaagggaacgaatcgcaaaggcaacttttcaaagccctgtctgggatgaacgtgacagaggcttatatgaagaggatgtttatctgaaacagtttcaggagctggatccagaggatgccgaggatattgagaaggtgataagaggtaccggcggcacgattcacaagagaccatatgcggatacctgggtaaaatatctgaaaagtaagggatatcatgtatatatcctgtctaattacagcagttatatgctggatcacacgaaaaaggaactgacattccgcagagaaatggatggagaggttttttcctgttatgctaagcagctgaaaccagatgcggaaatttatcagataattctgaataaatatcagttgaaaccggaggaatgtgtgttcatcgatgatcgttcggaaaactgcaggggagcacaggaacagggaattcataccatttgttttaaagattttaaacaggtaacagcagatcttgaaaaacttggtgtgaaataaaacgagaaaagtcccagaaccgcgtatctgtgtcagttctgagaccttttaaggggaggatataagtttttcctgaaattatcttttgcagtatgtttcctgaagaatccttcagggaacatttacagtatgaccggtttattttttatatatacacatttttcacaaaaattataagaataggatttgtgttttgggaaaaaagatgatataatggagcacaggcaaaatttttgaaaagaggatgaaacaatgagtgataaaacaatcttagagcagtggcgcgaaattgcttacaatcagcaggcagaccgcaatcagcttcagagattctgggcaaactattttaatattgaaaagggaatctacgaacagcttctttccaatccagatgaagttgtaagtggtacagtcaaggaactggcagaaaaatacggacaggatgtcctgactatggttggtttcctggatggtatcaatgacagtcttaagatcccgaatccgattgaaactatggatgagaatacaaaagtcacacttgcatttgacaaagaacttctttacaagaatatggttgatgcaaaggcagactggctgtatcagcttccacagtgggatgaaatcttctcagaagaaaaacgtaaagaactctacaaagagcagaaaaaatccggtacagttgtaaaaccgcataaaatcggccgtaacgatccttgtccgtgcggaagcggtaagaaatacaaatactgctgcggtaaataatgaaagccagagagaatctggattatatcattgtacttggcgcgcatgtagatggtacaagaatgacattagcccttctggaaagaaccagaagggctttgctctatcttgaagaaaaccccgggacaagggctgtgctttccggaggaatgggagacggggaacgaatcagtgaagcggaggccatgtacagatatctgacagaacatgggattgatggaggacgtctgatccgagaagaacgttcgaccaataccaaagaaaatctggattacagtctggagctgatcggcagtacggagccgacaattggggtagtgactaataattttcatgtgtttcgaggtgtaatgattggcagaaagtgtggctgtcgggaaatttatccggttccgtccagatatcgttcctggagacttcttctgtatattcccagagagatcctggcaattatcaaagataaaattgtcggaaatttataaacaaaataaaatataaaaaaaataaaaaaagtgttgacactttgagtgggacatagtatactaacgaagtcggttgcaagagcggcttacatagagtcggtcaaagtgacagatacaaaatgggatcttagctcagctgggagagcatctgccttacaagcagagggtcataggttcgagccctataggtcccattcaatatggcgagatagctcagttggctagagcacacggttcatacccgtggtgtcgagggttcgaatccccctctcgctattttgtatcatttatattgtatatggcgagatagctcagttggctagagcacacggttcatacccgtggtgtcgagggttcgaatccccctctcgctactttatcctctgtttttacagaggattttttttgtttgtcgtcaaatctgccataaaaaattttggcgtgagcaacagaaaaatttgcatctaggaatttgcaataatttgttgtatgatatagattgcgtaataaaacaaaagaaaggggacatcagaccgtggcaaagaaaatgctctttgtgtttaatccaaaagcgggaaaaggcaggattaagatgcatttactggatattgttgatatattcagcagtcatgattatgaggtcattatccgcgcaacacaggcaccgaaagatgcatatgaaaaagcaaaagaatatgcggactctgttgatctgatcgtgtgcagcggaggagacggtacattggatgaggtagttaccggaatcacagagaaaaacagtaatgtaccgattggatatattccggcaggaagtaccaatgattttgcaaacagtctctttatgcccaaaagcatggtgaaggctgctcagatgatcatggaagaaaatctgtatcactgtgatataggaagatttaacagccagacgtttgcatatgtggctgcttttggtctgtttacagatgtatcctatgaaacagaccaggatctgaaaaatgttcttggacatgtggcataccttctggaaggggtaaaacgactgttcgatatcaaatcctaccatatgaaagtaacctctgaagagattcaggtagaagatgattttatcgtaggaatgattacaaattccagatctgttggaggatttaaaaatcttactggcaaaaatgtagatatgaatgatgggctttttgaggtgacactgatcagacatccgaagaatcctcttcagctgcaggaaatcatgactgcactggtgatggctgaggacaacacggacatgatttattcattcaagtcaaagaagcttatgatagagacagaagaggaagtgccgtggacactggacggagagtttggtggtgatcacacttatgtggagattgaaaacaggcataaagcactgaacctttatttaaaaagtaccaaagccaaagaatgatcataagatcaaaactgagaaacatacagcaaagcataaaccaaaggagatagaagatgtcagactacgtgaatgtaaccgaacttttcggatgtgatgtattcaatgacgctgtcatggaagaaagacttccgaaaaaagtatacaaagagctgaaaaagacgatagaagagggaaaggaactttctctggaagtagcagatgtcgttgctcatgagatgaaagaatgggcaatcgagaaaggtgccacacattacagccactggtttcagcctttgacaggagtaactgcagaaaagcatgatgcttttatcacagctccaaaggaaaacggcaaagtactgatgagtttttcgggtaaagaactgatcaagggagagtcagatgcgtcttctttcccgtcaggtggacttcgagcaacatttgaagcaagaggttatactgcatgggattgtacttcaccggcatttgtacgtcatgatgcagctggcggaactctgtgtatcccgactgcattctgctcttatacaggagaagcacttgatcagaagacaccgcttcttcgttctatggaagcaatcaatacacagtctttacgtcttcttcgcctttttggcaatacaacttcaaagaaggtaacaccatctgttggtgctgaacaggaatattttcttgtagataaagaaaaatggctgcagagaaaagatcttacatatacaggaagaactttgtttggtgcgatgccgccgaaaggtcaggagatggatgatcattatcttggaactatccgtcagagaatttccgcatatatgaaagaagtaaatgaagagtgctggaaacttggagtaacagccaagacacagcataatgaagttgctccggcacagcatgaacttgcgccgatctatgcaccggtcaatattgctgcagatcataaccagatcatgatgcgtattcttaaaaaagtagcaagccgccatggcatgcgctgtctgcttcatgagaaaccgtttgcgggtgtaaatggttccggtaagcacaataactggtcactgactactgatgacggaatcaatctgctggatccaggaaagactccacatgagaatatacagtttcttcttgtgctgacatgtattcttaaagctgtcgatacacatgcagatcttctgcgtgaatctgcagcagatgttggaaatgatcagagacttggcggaaacgaagctccgccggctgttatttccgtattccttggagaacagctcggagatgtgcttgatcagctgatcagcactggaacggctacgcacagtaagaaaggcagccttctggagacaggtgttaagactcttcctgatttcatgaaagatgcgacagaccgtaaccgtacttcaccgtttgcgtttaccggaaacaaatttgaattccgtatggtaggatccagagattctatttctgaatgtaacgttgtactcaatacgattgcagcagaagcgttcaaagaagcatgtgatcgtctggaagctgccgaagattttgatatggcagtacatgatctgatcaaagaatatgcaattgatcatcagagaatcgtgttcaacggcaacggttatgcaccggaatgggcagaagaagcaaaacgtcgtggactgccgaatctgccgtctatggtagatgcgattccggcgctgactacaccaaaggcagtgaagctgtttgaggagttccatgtctttacaaagactgaactggaatcccgtgcagagattcaatatgaaatctatgcaaaagcggttaatatcgaagcgaagactatgatcgatattgcaacgaaacagattatcccggcagtgatcaaatatacgactgttctggcaggttccatcaatgcagtgaaagctgcaggcccgatcgatgtgagtgtacagatggatcttcttgagaaatgtacggcacttctgaaggatacgaacagtgcaatgaacagactgtccaaggtcgtggcaaaggttccggagattccggaaggcagagaacgtgcagtgtactgcaaagatgaagtatgcaaggctatgacagaacttcgtacaccggtggatgaactggaaatgctggtggacaaagaaatgtggccgatgccgtcttatggcgatctgatttttgaagtgtgatcttcaaaggagaaatttaagtgaatgaattgaaatttctggaggagcagggtgtctcctcctctttaataaataaaattgtaaagtttcgggaagtatatcccgtttctgatgaggtgaaaaacagaattatcaaacctgcaattccattttatggaaaagatattctggagatggccattgcagggatcctgcagggacagaatctgcttctgaccggaccaaaagccaccggcaaaaatattctggcagaaaatctggcatatatatttaaccggccttcttataatatttcttttcacgtcaatacaaacagtggggatctgattggtacggacacttttgaggataatgaagtaaagcttcgaaagggaagcatttaccggtgtgcagaatatggcggatttggaatccttgatgagatcaatatggcaaaaaatgatgcagtctctgttcttcatgcaacgctggactatcggcgttccattgatgttccgggatatgacaagatcgatcttcatcctgcagcaagatttatcggtacgatgaattatgggtatgcaggaacaaaagaattaaatgaagcacttgtatccagatttttggttatcgacatgccggcacagacggaagaaacgctgggatttatttttcatcagatgttcccgaatgccagagaaagcgcgatagagcagtttgttggattgtttctggacttgcagctgaaggcactgaacagtgaaatttcaacaaaagcattggatcttcgaggactccttgcggcaatgaaaatcgtggatgtgggactttccccggcaaaagctgtccgaatgggagtagttaacaaaacgtttgatgtattcgaaaaagaaatcgtagaagatgtggtaagtaccagaattccatcggaatggaccagagaagatgtatatgaataatacagaaccagttgaaattgatgaatatcgcctggaactggagaataggatccgtaatctgttgtggacagtaagcggagattaccaactggatatgaagcctgacgtatcgctttttctcagatcaaaggcaattgcactgtatgatggaatcaagcagggcgctcttgccagatattatgataaggatatgctcgggctttatcttgttaaaaaaatatttcttcaggcaggagagaatgagctgacgtttgtggcacagctctgtattgaagaggctataggagacaagatctgtgaagaacggccgggtatccgtgatatgcagagacagtgtatggaggatattctggaacaggaatttgatatactgccggatcttagagatattccgggaagattgaaagttgcagtgctccgcagaagactgaacaacggagaatggcatgtggagaaaaaattacagccatttatggagttgatagagagagctggtaacagtacagatacactggaactgatccgtgtgatcgatgaactgtataatcgattaatggatccgaattttgaaagtatgcatgggacattggaacaggtgcttgcagtgacgatggaagatcttacggaatattcctgggaggattttctttcagaggaaatgtatgaagaggtactggaaagttatgcagagcagctgacaaattctgtttccggccttgaaaattctgcagttacagaagaaatggaagaaaaacgtcaaaagaagcgttcggtcaaagtagttactccggagatgttggagaaagcttacacatatgtggaattaaattatggaaagtcttatttaagtgaagcagaagagaagaagatcaattatcagatgtgccggggaattcacagtgactgcagtctgtactttacggagggaattctcaaaaatccggtaaaaagcaattatcagtacgagtatgcaaaacgattgcgaaacaaaaatatctggctttatcatgacaaacacaggatcgtgaaacataatattactgtcctgacagaaacactccggaaatctctggtactcagaagtgagacacagactgttctttcggatcgtggaatgatcgtaccttccagattgtggcggattggccggactaatgatgcaaaactgtttcaacaggaactgaaaggagaaatatcggattttgttgtggatgttctgatcgatgcgagcggatcacagatgaagcggcagggtgatgtggcactgcaggcttatattatcagcgaggcactgagtaatgttgatattccgtatcgggtgatgagcttttgtaccttctgggattatacgatcatgcatcggtttcgcagatacgatgatccgcggtcagagaatgataacatctttaattatgttacgtcttcgaacaatcgtgacggattggccataaggactgccggatatgatctccttcaaagagaagaagaaaagaagattatgatcattttgagtgatggacgtccatatgatgtgatcataaaccgaccgaatgcaaaaaatccggagccttatcagggaaaggctgcaatcgcggatacagcaacagaagtgcggcgtctgcgtaatcttgatgtcagtgttctgggggtattcgcaggagaggaaaaagatctcgcaacggaaaaaaagatatttggtaaggattttgcttacatccgtgatattgcgaacttttcgaaaattgtcggcagatatctgacaaaacaactggaaattgatggataatagacaaaaatgtgcaacatttccaaaaagtgttaaataaaacgaacgaaaatataaaaaattcataaaatcgcccttgataatcaacatgaagtcggttataatggtatgaggttaatagaccaaaaaaaataagggagaggaaatcaatgaacgaaaacaaagagttcaaaccgtatattcctgctgaaaaagtaaccgcagaaatgacggtaacatctgtgatcatgggtgtcatccttgctatcgtattcggtgcagctaacgcatacctcggacttcgtgtcggtatgactgtttccgcatccattccggcagcagttatttctatgggtgttatccgtgtcatcatgaagaaaaactccattctggagagcaacctggtgcagacgatcggttctgccggtgagtcacttgcagcaggtgctatttttacaatgcctgctctttttttatgggcagaagaaggtctctgtgataaaccgagtctggttgagatcactctgatcgcactttgcggtggtgtccttggtgtacttttcatggtaccgcttcgtaacgctcttattgttaaagagcatgcgacacttctttatccggaaggaactgcatgtgcagacgtacttcttgcaggtgaagagggcggcgcaaacgcttctactgtattttccggtatgggacttgcagcagtcttcaaatttgttgttgacggtctgaaggttatcccggcagacgtttctgcagcatttacatcccttaagggtgagattggtatggaagtatatccggcacttcttggtgttggttatatcgtaggaccacgtgtagcatctttcatgttcgtaggttccattgtcggatggctcgtgatcattccgatgatttgtctgttcggaccagacacatggctgtatccggctgatccgggtgtgactatttcacagctgtatgcggctggcggtgcggcagcaatctggagcaaatatgttaaatatatcggagcaggtgccatcgctacaggtggtatcatttccctgatcaaatccatgccactgatcatcagcacattccgtgattccatgaagagcatgaagggcggatccgtaaaaggaactgcaagaacagacagagatcttccgatgaatttcattctgatcggtatcgttgcaatggtagttattatctgggcagtaccggctattccggttaatccgcttggagcactccttatcgtaatcttcggattcttctttgcaactgtatcttcccgtatggtaggtatgatcggtagctctaacaacccggtttctggtatggcaatcgctacacttctgatctctacaattgtgatcaagagcagcggacagactggaatagatggtatgaaagcagcaatcgcaattggttctgttatctgtatcattgcagcaatcgccggtgatacttctcaggaccttaagacaggataccttcttggtgcaactcctaagacacagcagatcggtgagctgatcggtgttgttgcttccggtcttgcaatcggtggtgttctgtatcttctggatgcagcatggggatatggtggagcagaagttccggctcctcaggcaggtctgatgaagatgatcgttgaaggtatcatgggtggaaatcttccgtgggcacttgtattcatcggtgtattccttgcaattggtatggaaatcttaagaattccggtaatgccttttgcaatcggtctttaccttccaatctatctgaatgcaaccatcatgatcggcggtgttgttcgtatgtttatggatggcagaaagaacgttgatgaaaaaacaaagaacgatcaggttacagatggtacactgtattgtgcaggtatgatcgccggagaaggtctggtaggtatcgcacttgctattctggcagttgctggtatcagtctggatgtatccggagttgttaactttggcaatatcggtggtgttgttctcatgatcatcatgattctgacactgctgaaattctccttatggaaaaagaaaaaagcctgatgagaaaacagaataaaaaaagcaaaaaacaaaatatagagattaattatctggatttaattccagtcagatcagaagagcttcactggcacaaagatatcaagggacgcgtgattctggatgtggaaaatacaggatggttcaacaagattgcacagactgtattcaacaaaccgcagtacaccaaggtgcatctggatgctcagggtacttttatctggcctctgatcgatggaaaacgtacggtgaccgatatcgcggcgctggtaaaagaagaatttggtgaggcagctgaaccgctgtatccgcgaattatcaaatatttccagattgttgagagctatcattttattaaatttgcaaatatgccttctaaatagggcacactaagaacgggaagcagcaaatcgctgtatcccgttcttttaggttaagggatactttattaagatatagagatatagcaacagagaaaggagtacttatgaaaattgctggaaaaaaaccctggtatctggaatatcttcttattattgtcggaaccggacttatgggaaccgcgatcacttcctgttttgatgcagcaggaatggtaactggcggtttttccggtattgcgatcctggtaaaagcctggacaaaaggtttgtatggaaatggaattccactctggataacaaacctgattctgaatgttccattgtttcttctcgctactaaaataaaaggttttgcttttgtaaggaaagcactgctgggagatatttcacttacaatatggcttgccattcttcctgcctggaaactgtctgaagattttctccttgtcgcattatatggaggtcttctgcagggaattggaattggatttgtatttctcggtggtggaacgactggcggaacagatatgctggctgcaattatccagaaatatctgcgacattattctattgcacagatcatgcagtttatagatggcgcgatagttgttgtcggcatgtatgtatttggagtggaacgtgcgctttatgcaattattgcggtatttcttgttacaaaagtatctgacggaatcattgaaggcttgaaattttcaaagtcggtatatattattacggataaaccagatgaggtttccagaatggtcatggaagaccttgatcgtggaattaccggcatttcggcaagaggaatgtactccggcgaggataagctgatgcttttctgtgtagtgggcaaaaaagaactggtacatctgaaagagaaaattgatgaaattgatgagaatgcttttgtcattgttggggatgcacgagaggtacatggggaaggttttatagaaaaataggaattttatacaaaaaaatgcaaaaaaattaagttttggtctttcatttttggtaattttatattaaaataacagataacgaaggaaagctatggggaaaaaggagaaatacgcataaaaaggcgggaagggatgtaagcagatgatatcaaatcaggtactacagaatacactagagggattaaaagaaatatccaggacagaattctgcattattgacacagaggggaaagtccttgcaacaacttttgcagatttttcaattcagccgggggatatacaggcatttgtgaaatcccaggcagacagccagcttgtgaagggattccagtattttaaagtctgtgatgactaccagctggaatatatacttgtggcacatggtgacgatgaagacacttatatggttggcaagcttgcagcatttcagatccagaatctgatcgttgcatataaagaaagatttgacaaagacagctttatcaagaatctccttcttgataaccttcttctggtagatatttataatcgcgcgaagaaactgcatattgatgcagatgttcgtcgtgttgttatgattctggaattgcagcaggaaaaggatcacagttccatggagagtgtgaaaagtttctttggcggcaagagcaaagactttatcacagcggtcgatgaaaagagtatcatcattgttaaggaactggaagatggcgaaggttatgcagagatggataagcttgcccatgcgattttggatacccttgggctgaaccagaatgaagagactcatattgcatatggaacgatcgtaaatgaactgaaagaagtttcccgttcctataaagaggcaagaatggcgctggatgttggcaagatcttctttggcgaaaaagatgttattgcttacagttcgcttggaatcggacgtctgatctatcagcttccaattccgctgtgcaaaatgtttatcaaagaaatttttgagaataaatctccagatgattttgacgaggaaacactggttactattgataaattctttgagaacagcctgaatgtttcagaaacatccagacagttgtatatccacagaaatacactggtctatcgtctggataagttacagaagagtaccggattggatcttcgtgtatttgaagatgcgattacattcaagatcgcactgatggtcgtacgttatatgaagtacatggaaacgcttgaatattgatcgcacgtcgatatgaaaattttgtgaattcaataaaaatgcttgcattccagcataatatatgttacaacattgttacgaaatgttaataaactataccgcaggatgcaatgaaatgctgccgggattctggcagcattttttatggagtccagagagacatatttgttttaggcagttgcagcacttttggaccggatatagatagaggaggatattatggaaacgatgatcgatctgattgatgtgacaaaatcgtatggtaaaggccttccggctgtgaaccatgctaatttgcacgtagataaaggagaatttgtttttgtagtaggaagcagtgggtcaggaaaatctacactgatcaaacttcttatgaaagaacttgatagtacaagtggacagatgatagtcagcggtgagcgtctggagaagatgaaacatcgtcgagttgcgaaataccgtcgtaagcttggtgtagtatttcaggacttccgtcttctgaaagaccgcaatgtatacgaaaacgttgcatttgcacagcgtgttatcgggagaccaacgcgagtgatccgcagacgtgttccggaggttcttcaggaagtgggacttgctgaaaaatacaaatccttcccggatgagctttctggtggtgagcagcagagagtggcgcttgccagggcacttgtaaatcgtccggatatccttctggctgacgagccgaccggaaacctggatccgaagacttctgaagaaatcatgaagcttctggaacagatcaatgagcgtggtacgactgtgcttgtggtaacacataacaaagaaatcgttaatcagatgaagaaacgagtggttaccatgcatgacggtgtgatcatcagtgatgagaaagaaggaggatatcatgaggcctagtacaatctggtataccctcaaacagggtatcaaaaatataaaaagaaactggatgttttccattgcatctattctgaccatggcagcctgtatctttctggtaggtgtattttattcactggtaacaaatgtagataatattgcacagaaagtagagcaggaagttccagtcactgttttttttgatgagggaacgactgaagaacagatgcaggaagtcggcaatctgatccaggcacgtccggaagtggaacgagttgagtttgaatcagcagagcaggcatgggagaactttaaggataaatatttccagggatctgatgcggcagaaggatttaaggatgacaatccgcttgtcaattcttcaaactatcatgtatacctgaatcagatcgagaaacagacagagttagtaaactatattcaggggttggagcatgtgcgagatgttgagcagtctgaacaggcagcaaatacgctgggaagctttaacaagctggtttcctatgcatcgatcgtgatcattgcgctccttctgatcatttctattttcctgatcagtaataccatttctgttggtatttctgttcgtaaagaagaaattggaattatgaaatacattggagcaacggatgcatttgtccgtgcaccgttccttcttgaaggtatggtccttggagtgatcggtgcagcgattccactggtagcactgtatttcctgtacaatagtgttgttgagtacatcctgaataaattcagtgtgcttacaggtgtggttgcttttattccggtatggcagatttatcagatacttcttccgattggacttgctcttggaattggcattggtttcattggaagtatgatgacaacaagaaaacatctgagagtgtaattgtgaaagtgcaaggtgtgaaataaccatcagggatcatataagtaaataaaagaaaagcggcatgggactttaagttctgtgccgcttatgttatatttagataccagggttaaaggcacgaaaattaacaatacaacaggaaaggcagtcgtaatgaagcataaagaatacgtgacaggagttgtgacaggagttttggctgctgcacttgcagcaggtgggttaaattatgtacatcagaatcaaagtgggagtgttctggcggactcagcgcacgtagaaaaagtagaatatctggagaaactgatcgatcaggaatatctgggggatgttgatcaagataaactggcagagggaatttatgcaggactgatttatggcctgggagatgtgtattccagatattatacagcggaggaatatgcgcaggagaccgcaacaacagatggctcttatgtaggaataggggtatctatccagaaaaataaaaacggtggcgtacagattgcagagtgctacgagggcggttcaggtaagaaagccggactgatcgtaggagatgtgatcactgcgattgacgataccgatgttacggatatggaactctctgaggtagtcagcctgatcaaagaaaataaagacaaaaacattgttctgaccgtccagagggaagatgaggagacacctcttcagatcactgtagaagtaacagatgtggaacttccagccgtattcagtgaaatgctggatgatgagaccggatatatccagatcacgcagttcacaggcgttgcaccacagcagtataaagatgcttttgtggatctaaaacagaaaggaatgcagaaactggtagtagatcttcgtgataatccaggtggacttctgacgtcagtatgtgagatattgcgggatattcttccagaaggactgattgtttatactgaggataaggatggaaatcgggaagaagagacttgtgatggcaaaaatgaactccatatgccattggctgttcttgtcaatgagagcagtgccagtgcttcggaaatttttgccggtgcggtccaggattatgggatcggaaagattgtcggaacaacaacttatggaaaaggcgttgtgcaggagctgagacagcttcgtgatggaagcgcagtgaaacttactgtttcaaactattatacaccaaaaggaaattctattaataaagtaggaatcaagccggatatcgaggtcaaacttgcatcagaactgttgaataagacggaaatcagtcatgaggaggataaccagctgcaggaggctttaaaaacgctgcaatagatcagtacgtaagataaaattaacaaatttaaaaaaaatgtaaaaaatacttgctttttattcaattatttcttaaaatatataaaggctattttgtataaggaagggaatgatttcatgaataacacagacaagtacaaaagagactttgccagagtcctgacacttcttatgctactggctgcattatttgtaacagacattccggtaagtgcagatacgacagacagtgccactgtttcaagcatcagtgcagttaccgagaaggcagagataaaagcttccagcaatacagcacttaagatcagctgggagaaatgcccgcttgcacagggatatgtgatctacagaagagaatctacaagaaaagcattcagaagaataaagaaagtcagcgccagcaggacaagctatattgataaaagactgacctcaagcaaaccgtatcagtatgcagtgcgtgcgatacgtaaggaaaatgggagatatgtatacagcagatatcttatggtaacaggtgctacacgtcctgcaaccgtgaagacaacgatcaaggcagcttccagttcaacgatgaaagtgacatggaagaagagctcgagagcagatggttaccgtatttacagaagacctgctgccggaaaatgggttctggttgctgatgtggccaaaaatctgacttcatatacagatacaggcttgaatgcaagtacgaaatatgtgtatacagtacgcccatataaaaaaggcggtaatgtaaaatatatgtcagccgtgaagctgagtaataaagcatcaacgccagcggcacccaaggttacgccgtcaggcgacacatcaaacagtagtgttatgtcaaataccaggtttactgcagcacagaaggatgtcatgaaaaaaatcctctatgcggtggaaacaggtggacaggtttatggaaatcagaaatatggtgatttcacagaggcttttacaaacagcagtacagagtacacgatcacaattggtgcaggtcagtggtatggtacagaagcacagcgtcttctgaaactgattcatgcaacgatgggagaggatgagtggaataagatcgatacaggaaatcattatgtatggacagctgtatgtaatgaagactggacaaaatatcgaattcccaaaagctcctggagagcaagagttattgtaaaactgcttcagacagatgctggaatcaaatgtcaggaccagctgatgtatcagcagatcgacgaatatgaagcagaagtacggaaacttggtgtatcggatccacaggctgtagggatgtttatcaacatccgtcatcaaggtggatacggagctgttacgcgagtccttggaaaaactgcaaagccggttaatctgatcaatgtgtacagagcacttgccacagattccggtggacaggtaggtacatataagacaaggcaggcaaaagtatatcagtggctgctgacatacatgaaataataagagtacatcaggggctgatctcgcatgagagatcagtcctttctttttgtgaaaatccattgcgtatggcaagtgtaaaatgttataatgatatagatttttttgtagaatgcagggagaaaagaaatgattttaactgaagataagatctataccatgtcactggagacggaatctgtcaatcgtgacagcggattaacaaataatacgatagaattggaatttacaaacaaagagttattacatgcaattgttacctgtggaatgccgatccagagactgacagctgcatttccggagaagaaacgttttgaattcttatacaaactttttcttgtagaaacagctcttgatgcagagggagaccgcctgaaaaaatcaaagaagatcgcatatctggattcttctgaaaagagtgtgatttcctactatatgggaatgttttttacaaagatgatcagtcgccgactgtatggatctgagtacctgacaaatctgaatctgattgagacaccggatcacaaagaatttattgatttttttgccagtgaatggcgcccagagatgataggctacagaccggatgctgatgcctggaatgtctgggaagcaaaaggtggaagcaactacagagagcaggctctgaagaaaggtgctgaccagctgaaggcaattggcactgtaaatggggtgcgcccggatccggcggcagtctgcatgacctattatgatcatggctatctctgcggaatattgagagaaccggaaggcaatacagaaggggaacagttgaagttcactgaggaggatttttataaggcatattatgaaccaatctgtgaactttttctggataaaggcagcaacctcagattacatgatctctatgcggaagtatcactggaagtgccatattttacagaaaattacagagaaccggatgaaagaaagatatgtattggaatttccagaaaattattgaactgtctgatggaagaagattattctgcggtagctgaaataagaaaaaatgtgcaggaagaaatctgtccggatggtgcttatatgggtgcagatggtatttttataagataaagaagaacagataaataaggatagcgaaagagagagtattcagtgctctctcttttttcacagacgggaaggcagagcatttcgcagtggaaaagataattttttttaaatacaaaggaatcaaatattgtaatcgagtcattgatatggcataataaatatgtatgaggttaaaaataagaaaaaacaaagttaagaaaatgtaaaaaaatactttacagaaggagctgttccgaaagaaatactgagctgacgggacggccacagaggagaaaaaaatggcagtattttcaatgatcttatctttgctctcaggagtagcattatttctgtttggaatgtctttgatgggagatggcctgaaacttgtagcaggtaataagcttgaggcatttctgtaccgtatgaccaatactccgctgaagggagttgcacttggcacttgtgttaccagtgttatccagtcttcttcagcaactaccgttatggtcatcggttttgttaactccggtatgatgaaactgaaacaggcaatcggtatcatcatgggagcaaacatcggaaccagcattacaggatggatcctgtgtctgtcctacattcagggttccggtggtattgcaagtattctttctactgcaaccatttcagcagtagtcgcagtcattggtattattcttcgtatgttctgcaaaagatccgtacataagaatatcggaaacattatgcttggtttcgcaattctgatgacgggtatgcagaccatgagtggtgctgttgcaccgttgagagaaagcccggtctttattgacatgctgacgatgttttccaatccgatcgcaggtattctggtaggtattgctttcacggccgtattgcagagtgcatctgcgacagtcggtgtactgcaggcactttccgtaacaggaatcttgacatttgccagtgcattcccgatcgtccttggtatcggtgttggagcagcctgtccagttctgatctctgcaatcggagctaataagaatggtaagagaactgcactcatctatctgatgaatgacttattcggcctgattttgtggtctatcatcttctataccgcaaatgctatcgtgcatttcggatttatggatatgatcatgactccggtaacgatcgcagcactgaataccgtgttccgtgtagctacagttgttgttctgtttccatttattccgaagcttgaaaaactggtgtgcatgcttgtgaaaaacagtgcagaggaattggaggatgaggcagacttcgatcttctggaagaacgtctgatcaattacccggcacttgcaattgctcagtgtcaccgtgcgatgaacggcatgtccaaaaaacttcgcaagaatgtcaacagagccatgaatcttctgaatgattatcagcaggataagtacgataaggttcaacgtaaagaagatctgatcgacaagtatgagagccgtctgggagaatatctgattcagcttaccaaacgtgagatgaatacagcacaaacaacacaggtttctctgtatctgcatacgatcaatgactttgagagaattggtgaccatgcttcttatattgcacatatggcaaatgaaatgcatgataatcatacacagttttctcaggcagcctgggatgaactgaatatcgttatggaggcagttcgagaggagatcaatgtcacctgtaatgcatttatgaaagatgacaaggaagcagctcagagagttgcgcctttaggggctgtgatcacaaacctttgtgatgagttaaaaatgcaccatgtagaacgtctcagtaagggagaatgcggacttgaggaaggaaccgtttttaacgatatcctgaacagctttggccgtattgcagcgcacagcgcaagcgcaatgaccgcactcttaaagagcggtgatacagatgcggatccgcatatccatgattccaagatctatccgacagacagctgggagtattacacatatttcaatgagtacagacagaagtatgatgtgattgctaatgctgaacatgttttaagcatggaaccggaagaggtagaataataaaaataacagagtaaacagaaattacagagcaggatttaaaatgctctgtaattttttgcatagatataaatttatggatatgctatactgagtgaaaaaacttttgtagttagtttataaaagctgacattggcttcgacaggaaaaaggcgtcgtgacgatttgcaaagaaggcgagatatccaaattcgtagagaaagtctccagcgtcagtttctcagcaaaacgtgcgattgaaaacggtcagaaagttctatatgtgacagaacgttgtgttttccgccttactccgaaaggtctgaaattaatcgaagtgtatccgggtgtggatatgaagaaagatattatagacaggctgccatttgaggtagaagtctgagataatgaaaaagtacagaacaaacatttgtatgaatgtgatatatatgaaaatagcgggaggtaaagtaaatgacgaaacttgaaaattttgtaagaatgatgacaggacattttgataataaggatcaatttgataagatgcaggaagaaggaaaaacatatccatatgctgaacatataaatacaatctgtaatgacaaaataaataatcttcctgaagatttcaaagacatatttgttgttgaagagagttactatgaaattaatgggaaacgtcatgcatccccgcatcttttccttatcacggaaatagaacagggaattttactttcttcttatgaaattccaaaaggagaagataaaaatacattttcatatgattctatgaagaaggttgattacgctaaactaaaaaaatctgaaaaatttactccggcactttatcatgaaaaggacggaatctgggagggaggcagtacaagccagttttctccggtaatgacctttaaactttgggaaaagttttccgatgatttcctggaagtatctgaaagcatggaagttaatgggaagagaacttttggatatgatgaaccaataatttataagcgtgtataatcaaatagcggtatattgatatgactttcagtttgtttggctcataacaatttagatgaacttttttgatataaaaaccaggaggtgtttttgtgcaggcttcacaacaaatcttcagacttcattccgaatacaaacccacaggagatcagccccaggcaattgaaaaactggtggtattttgtggtatgtgggtggttgaacatccggatgttgtggaagcgatagtggtgagagcataggtgaaaagcgggtggatgaagagggtttgtgacttttcatcgcctgctttttgattatagatgttgaatgtgacaggaaggatggactgggagagatagaagaaaaaagaattagaagtttttatttattgtaatatttcatgtagcggcattagtaaaatagtgtcgctacaaaaagctgacttatacattgatattatatgcataactcaaaataaaattgttaaaaatagaaaaagaaacaatatataacgaaaaaatctctaaataagaaatttacattgactgagagaagagtaaaacatataataaaggtggaggtgtataagaatgttagtaaaagtaagtgttgaaaattttaaatcttttgataaagcagcagagctgacaatgatttcctcaaataaaatacgaacaaatgcaaatcacaggttaaagataaaaagtacccagttattaaaatatgcagtagtttatggagcaaatgcatctggaaagaccaatctggcattgttctttaaattttttaaagatagtgtctgtaatggtattccgatagaagctacacagatgttttgtaagaatcggcaggagaataaggaacgagaaagtagttttgaaattcagattactgtagatgacaaattttatgcctatggtttttccgcagttttaagcagacgaaaagtaaccggagaatggttatatgaattatatcagaatggttcagcaaaatgtctctttgaacgagaaggaagtaaacgtccggtgttaaatgatggtattacgctgacaaacacagaaaaaaataaatttgaaacctatgcagatgattttgaaggaaatgaaacatctttgttcctgacagaaatgaatcgtggaaaaaaatatagcacacgatctaaattattgtttttccgggatgtatatgattggattcagaatcatatttcgattatcacaccggatacgccattgattgatttggaatattattatgatgataattcgctgaagctgattaacaaattgatcaaaacatttgatacgggaatcagccaggtgaaaattgaagaaattacattggatgagttatcaaatgcattgccgaaatcagtatttgataagatgatgcagcatgtaaaaaatagaatggaagagcaggaagaaccatcattcagaatgacgatgaggtcgaaggaaactttctttaatatcgaagttgaaggacattctgaaccgaaggtcacaacaatccggttgcatcataataaatcgttttatgagtttggctttgatgaagaatcagatggaacaagaagattattcgatttgatggatatgctgttgaataaacgagatgatgttctttatgttgtggatgaattggagagaagtttacatccgaagttgacagaacgatttttgcaattgtttatgcagctacatgatgagcagcgtatgcagctattgttcactacacatgaatcatccattatggatcaggctatttttagaagggatgaaatctggtttgtagaacgtaacgcagaaaatgcaagctctatttattccttagatcgtttcaaggagaggtatgataaagtgttgagcaaggcatatttggaaggaagatatggtgcgataccggtattttcaacattcgattttgcgcgagcaacgagtcagacggatgtgcttgcacagacacctgacgactgccgcgacagtgcagaaagtatttctgtaccgagagaggaggagtagccttggctccagtaagaagttatacgaattggaatagtagaactacagatgaagaagaacaggtcgaaacatataaatgaagattatatagaaggatgaatgtatggagaataaagttataatattaggtgctggtataggtgcaatgacgatgggatttgaaaatgcgggttgtagcgttgttgcagcttatgaaagggatagaagggcaattgaactttataagaaaaatataagtggtgaaataaatgaactggatcaattaggaacaagcaatttggaagatgtgccggatatagatatattagcatgtgatttttatagagatttaagtatagttggtcgaaaccccaaaaatactacagatatcaataatgccattcaatttattttagattatagaaagcccaaaattatatgcttttttatcccccgggcttgtttaaaatgggaaaagtttgtacagctgttagggaatataaataacagaggatatgattacaagtataaacaaatatatacagaacaggcaacaggactaccgataacagaaaagagagtctatttggtggcaatccatagatcattaggcgatgtatttgaatttccttgttttgatgaaaagaaaatgttttctctagaagaaatattggaaaataagcctgtagaagaattttatcgaaaagttaattgtaattgtgttaatgagataagcacaaaagatacatttttttgttggaaacaaaataaatacatagaatcagatttggcagatacaaatttaataaagattccattagtcaggaatgaaaaagtaatcagaaagataactcatagagaattggcaagattgaagaatctaccagatgattatcaacttgatacaagaaataaagcgtggatgtatagacagttgatgtatgcccctaatacaaaaatcatggaacaaatagcaagtgaaataggaaatacattgaaaagaaatattttacaaaagtcaaatatgatgagagaacaaacatttgcagagttgtttaggagatatcttatcgcaaagtgtaaaaatatagtagaagaaaaattgtgtgattttaaatgtaatgttgatggaaaagatatttgctttgaattaaaaatttacaatagtgattatgcaattgaaaaaaatataaagcgagcatgtgaaagattattgcgattaaaaggtgataatttaattttagttataggaaacgttgtttcaaaagaaataaaagcaaattgttttgaagtatatgggatacatatttgggatgtgaaaaatttgctttggttatttgaagaattctcagatataaaaaatgaatttatatcgttattaacatatagtatagatgatttacaattagaaattccagagccacaattatttgaagaaaaacaaatcgaaaaaagggagagaacatgggaagaacggttaaaaaatatacaacctggaaaagaattttttaaggaatatgaaaagatttgtacagaaattttgaaaaatatacttggagagtatttgggcttatgggctgtgcaagagcattcaaatgaagagttatactgttttgacttatgttgtaaaatcaaaaatggagtggatcaggatttctttaacacaatacaaaattattttaatacaaaatatatagtatttgaattcaaaaattataaagaaaaaataactcaaagagaaatttatacgacggaaaaatatttgtataaaaaggcattaagaagtgtagcaattattgtgtcaagagaaggagcaagtagaaatgcacttttagcagcaaaaggttgtttaagggaaaacggaaagttgattttatgtttatctgataaagatttaaacgaactgattcatataaaggaaaaaggcgaacagccaacagcagagttttttgaagctatgttagatgatatactgatacatttggaaaagtaaaaattaaaagtatagaacaaatatcatgaggaatctttttagaagataataatattattgatgaaactggagattatgtaactatatgttcaacccagaagatggataaaaaaagatacaatgcttacaaactattagccatgaattatgggaaactggaagaatgtatatatgaagatgggacgtttagtatttcgttaacatgttcaagttatattaagggacaacaacttgcagcatatattgaacaaaaagataatgtgattctagcatatggataactgtggagaaattatgtgaaatgatagaaagaagtacagaacaaacattcggtttgccctgtactttttttatatgtaatgatatactgaaaacacaaccatactaaaagagacacatcttaattttagataaatgaaatttgtttaaaacaggagaatgctatggatcattttgaattacattccgaatacaaaccaaccggtgaccagccccaggcaatcgaaaaactggtcaaaggctttaaagaaggcaaccagttcgagactttgctgggtgtcacaggttccggtaagaccttcaccatggcgaacgtcatcgcccagttaaacaagccaactttggtacttgcgcacaataaaacactggcagcacagctctacggtgagatgaaggaattcttccctgagaacgcagtggaatactttgtttcctattatgattattaccagccggaggcatacgttccatctacggatacttatatagcaaaagatgcttccacgaacgatgaaatcgataaactccgtctttctgcaacagcggctctctgtgaacggaaagatgttattgtggtttcctctgtatcctgtatctatggtctgggtgcaccggaagaattctttgatatgatgatctcacttcgtccgggaatggagaaagacagggatgaggtaatcaaagaactgatcgatattcagtataaccgtaatgaaatggatttccatcgtggtacgttccgggtacgtggagatgtgctggaaatcttcccggccaactattctgaccgggcaattcgtgtggaattctttggagatgagattgatcgaattacagaagtatatgtgttgaccggtgagattcacaatgaactgaaacatgcggcgatttttccggcatctcattacgttgtaccacagagccagatccagaaggctgcagacgcaatccttgaagaaatgaaagaacaggtttcttattttaaaagtgaagataagttgatcgaagcacagcgaattgccgagagaaccaattttgatgtagaaatgatgaaagagacgggattctgctctggaattgagaactactccagacatctgacaggacttgctccggggcagccaccatatactctgatggactactttaaagatgacttccttcttattatagatgagtctcataagactgtatcacaggttggaggaatgtatgcaggtgaccagagccgtaagcagacactggtagattatggcttccgcctgccgtcagcgaaggataaccggccattgagctttgcggaatttgaaaataaactcgatcaggttatgtttgtttcggcgacaccaggacagtatgaagcagaacatgaacttcttcgtgcagaacagattattcgtccgactgggcttctggatccgaaagtagaagttcgtccggtggaaggacagattgatgatctgatcagtgaagtaaataaagaagtcgataaaggtcacaagattttgatcacaactttgacaaaacgaatggcagaagatctgaccgattacatgaaagatgtcggcatccgtgttcgttatttgcattcggatattgatactttggaacgtgcagaaatcattcgtgatatgcgtctggatgtctttgatgtgctggttggtatcaatcttttgcgagaaggactggatattccggagattacactggttgcaattcttgatgcggataaagaaggattcctgcgttcagaagtttccctgatccagacgattggacgtgcggcccgtaacagtgaggggcatgttatcatgtatgcagatgtcatgacagattccatgcgaaaagccattcaggagacagaacgaagaagaacgattcaggaggcttacaataaagaacatggaatcacgccgactacgatcaagaaagcagttcgtgatctgatcacggtttccaaggcagtcgctgagacggaagacaagcttaagaaagatccggagtccatgacaagaaaagaactgacgaagctgataggtcaggtggagaaacagatgcgtgcagcagcagcagatctcaactttgagcaggcggcagagttgcgtgacaagatgatcgaattgaagaaaagcctcgatgaaatggatgaatagaaaaagtttataatctcaaagaaaaattccccctgtctgtaaaaagtttcactttactcttgtacagcaatgcagagagtgctaaaatggaacaagcactaaacgaaagaggtaatcgatatgcagttttccaaaagattagacagatttggagaagaaatctttgcagccctgaataacagacgtatggaactggaagcacagggcatgaaaatttataatatgagtgtgggaactccggattttaagacaccggagcacattaagaaggcacttgctgctgcggcaatggatgacaataactggaagtacagtcttcgtgatctgccagaacttctggaagcagtatgtacatattataagaaacgttttgatgtgaatctgacaccggatatggttatgactgtttacggcagtcaggaaggtatgggacatcttggaatggcactttgcgatgagggagatgttgttcttcttccagatccatgttatccggtatttgcagcaggcagtctgatggcaggcgcagtgccatactattatccgctggtggcagaacacgactttcttccatatgtaaaggatattccggaagaagttgcaaagaaagcaaaatacatggtagtttctctgccctccaatccggtaggaagcattgcaacaccgggattatatgaagaaatcattgcctttgcgaagaaatatgatattttgatcattcatgacaacgcatacagtgatatcatctttgacggagcacatggcggaagttttcttgcaacagaaggagcgaaagaaatcggcgtggaatttttcagcctttcgaaatccttcaatgtgacaggagcaagaatcagttttctggttgggcgtccagatgtgatcgcggcacttcgcaagctgagaagccagatcgattttggaatgtttctaccaattcagaaggcagcgatcgcagcattgaatggcccactggaaagtgtgcaggagcagtgcagaatgtatcaggaaagaagagatgcactctgtaatggccttcgtgaaatcggatgggaccttccgaatggcaagggaacgatgttcgtatgggcaagaatcccgggaggacgtacagacagtatggcattctgcatggaactgatggaaaaagccggtgttattgtgactcctggtgcaagctttggaccgcatggtgaaggatatgtacgtttcgctctcgtcctgccaccggaaaaaatccgcgaagttgtagaagctatccgtaaaagcggaatctgagaaagtaaacgaagcatattaaaaaatgcattcataataaattaagaacagaaattcacataatcacagtacttttgacacaaagtaacagagtggaaaggtagattttcccgatttgtgtccgtactgtgatttttttcgatttttttaaaaaatataaattagatgttgacaaacaattacgacagtgctatcttaacagtatagatgttagcactcctcatcaatgagtgctaacagactgataggaaaggagctgagaacatggatgaacaattgacggatcgtaagaaaagaattttgaaagcgatcatcaagacatacatggaaacgggcgaaccggtaggatccaggacaatatccaaggatgcagacctgaatgtcagctcagcaacgatccgaaatgaaatgtctgacctgacagacatgggctacatcgttcagccacatacatcggcaggaagaatcccttctgataaaggctatcggctttatgtggatgaattgatgagagaaaaggaagatgaaattgcagaaatccgtaatctgatgattgagaagaccgataaaatggaaaaagtgcttaagaatgtagcacgtgtcttggcttccaataccaattacgcgacgatggtttcagttcctcagtacagcggcaataaattgaaatttattcagctgtcccgtgtcaatgagctacagttagtagctgtggttgtctgcgaaggaaatgtcatccgtaatcagatcattgatctggatgaagaaatggatgatgagacacttctgaagctgaaccttcttcttaataccaatctgaatggcctgccgatacaggacattaatctgggtatgattgccagactgaaagaacaggcaggaatccacagtggactggtagcaagagtgctggatgcagttgcagcaaccattcatgtcgatgaagacgatctggaaatctatacgtccggtgcaacgaacttctttaaatatccggaactgtcggataagaccaaagccactgagctgatttctacttttgaagagaaacagcagttggttgatttggtcaaggagcgaatggcagatgacaataccggtgttcaagtatatatcggagatgaacttccaatttctaccatgaaagattgcagtgttgttactgcaacttatgaactgggagagggcatgcatggaacaatcggtatcgtaggaccgaaacgaatggattatgaaaatgtagtaaatagtctgaagactctcaaggtcgaactcgatgaggtattcaaaaaaaataaaagtaatcaagacagttagctgtcagactggaaaggcggtagaaagaacgtgtcagaaacaaataaaaaagaagctggcgtacaggaagaaacagagaaagaccttccggaaacagaacctgttacagaaccagtagaagaatcgccggaggcaaccgcaggaacggaaaccacagaggaaaccgagagtgcagctgaagacgataaggaatctgataaagaaaccaaaggaagaaattctttctttggcaaaaagaaaaaagacaataagctggaacagcagattgaagatctgactgacagactgaagcgtaacatggctgagtttgataacttccgtaaacgtacggaaaaagaaaaatccagcatgtatgtgatcggagcaaaggatatcatcgagaagatccttccggttgtagataactttgaaagaggccttgcacaggctccggaagatgatccatttgcagagggaatgcagaagatctacaaacagtttaccactacaatggaaggcatgggagtagaaccgatcgaagctgttggaaaagaatttaatccggatttccacaatgcagtgatgcatgtggaggatgaagctgttggagaaaatattgttgtggaggagcttcagaaaggatacacctacaagggatttgtagtccgccacagcatggtaaaagttgcaaactgatcgtgttcaaggaaaaaggaagcggctgcgaagcagacatttactttttctggcacgatcctgacagaatcataagtgcatagcacgaaagatgcgtagagcatcttgattctggaaggacaaactagaatatataataatcttagaatatatacaggaggaatattatcatgggaaaaatcattggtattgacttaggtacaacaaacagttgtgtagctgtaatggaaggtggacagccaactgttatcgcaaatacagaaggagcaagaactacaccgtctgtagttgctttcacaaaaacaggagaacgtctggtaggtgagcctgcaaaacgtcaggcagtaacaaatgcagagagaacaatctcttccatcaagagagagatgggtaccgattatcgtgtaacaatcgatgacaagaaatactctccgcaggaaatttccgcgatgatccttcagaaactgaaaaaagatgcagaaggatatcttggagaaagcgtaacagaagctgttatcacagttccggcttacttcaatgatgctcagcgccaggcaacaaaggatgccggtaagattgcaggtcttgatgtaaaacgtatcatcaacgagcctacagcagcagctcttgcatatggacttgacaacgaaaaagaacagaaaatcatggtttacgacttaggtggtggtacattcgatgtatctgttatcgagattggtgatggtgttatcgaagttctttccacagctggtaacaaccgtcttggcggtgatgactttgaccagaaagttacagactggatgatcgaagaattcaagaaagcagaaggcgtagacttaagcgcagataagatggctcttcagagactgaaagaagcagctgaaaaagctaaaaaagaactttcttccgcaacaacaacaaacatcaaccttccgttcattactgcaacagcagaaggaccgaagcattttgatatgaaccttacaagagctaaatttgatgaactgacacatgatctggtagaaaagacagcagaaccggttcgccgtgcactgtcagatgcaggtatcacagcttctgagcttggccaggtacttttggtaggtggatctacacgtatcccggcagtacaggacaaagtaaaacagctcacaggtaaagaaccaagcaaatctctgaacccggatgaatgtgttgcacttggtgcttccgtacagggtggaaaacttgctggtgatgcaggtgccggtgacattcttcttctggatgttactccactgtcactgtctatcgagacaatgggtggtatcgcaactcgtctgatcgagagaaatactacaatcccgacaaagaagagccagatcttttctacagcagcagacaaccagacagcagtagatatcaacgttgtacagggtgagcgtcagttcgcgaaggacaacaaatcccttggccagttccgtctggatggaatcccgccagcacgtcgtggtgttccgcagatcgaagttacatttgatatcgatgccaacggtatcgtaaatgtttctgccaaagaccttggaacaggtaaagaacagcacatcacaatcacagctggttccaatatgtctgattctgaaatcgacaaagcagttaaagaagctgctgagttcgaagctcaggataagaaacgtaaagagggaatcgacacaagaaacaatgcagactctatggtattccaggttgagaatgcactgaaagaagctggcgataagattgatgcaaacgataaagctgcagttgaaacagatctgaatgcactgaaagatctccttgctcagacagcaaatgcagaaatgacagatgcacagatcgctgatatcaaagctgctcaggaaaagatgatggaaagtgctcagaaacttttcgcaaaaatgtatgagcagacacagcaggcaggcggtcaggctggaccgaatccgggagctggtgcaggtgcaggtgctgcacagggcggcaacgaagctggatacggtgatgatgtcgtagacgctgattacaaggaagtataataaagtaaaaaataagatgtaaaaccttagatgccattcatgcttgcatgagtggcattgggggattataataatattttgtgtggcatatagctgcataagaacaataacgcaaatctaacatataggaaagagaaaagatggctgataaaagagattactatgaggtcctgggtgtcagcaagactgccagtgattcagaattaaaaagcgcatatcgaaaattagccaagaagtatcatccagatgttaatccgggagacaaagaagcagaagctaagttcaaagaagcaacagaggcatacagtgtcttaagtgatgcagaaaagagacgccagtacgatcagtttggtcatgcagcgtttgaacagggcggtggtggtgccggcggctttggtggatttgatttcaacggcgcagacatgggagatatcttcggggatattttcggagatctgtttggcggcggtggaagacgtcgtgccaataatggaccgatgaagggtgcaaatttacgcgcccgtgtgaatattacatttgaagaggcagtgtttggatgtgacaaggaactggagatcgttctgaaggatgaatgtacgacctgtcatggaactggtgcaaagccgggaacacagccgactacctgtccgaaatgtaacggagaaggtcagatcgtctatacacagcagtctatgtttggcatggttcgaaatgtacagacttgtccggaatgtaatggaaccggtaagattatcaaagaaaaatgtacttcctgccgtggaacaggatatacttcttccagaaagaagattcaggtttctattccggccggtattgacaatggacagagtatccgtatccgtgataaaggagaacctggaaccaatggtggtccgagaggtgatttgctcgtagaagtgaatgtagcccgtcatccaatcttccagagacaggatatgaatatcttctctacagccccgcttacttatgcgcaggcagcgctgggtggagaaatccatatcaatacagttgatggcgatgtggcatacgaagtgaagccgggaacacagacagacacacgtatccgtctgaagggtaaaggtgtaccgtccctgagaaataagaatattcgcggtgatcactatgtgactttggtggtacaggtaccgaccaagctgaatgaagaggcaaaagaagctcttcgtaagtttgatgaggcatgtggaaacagaccggccgctgagccaaaagacggatctgagaaatcagaaaagaagaaaaagagtttcatggacaaaatcaaagagacttttgaggattaattctataaaatagaagaaacttttcgggaaaagagggaaaacccctcttttctttttttgggttatcatgtatattagatagcagggttaaaaatacagaagctgttcgtgcttgcacgataaggcaattgcaattgttgtataagttaagacaggagattataatatatgaaatggaatcgttttacgattaaaaccaaaacagatgccgaagacatgattatctgtacattggcagaaataggtgtcgaaggtgcagagattcaggatcaccagcctttgacagaggaagataaggcacagatgtttgtagatatcatgccggaaggtccagaagatgatggagttgcatatttgaatttttatctggaggaagatgcggataaggatgtaattttacgtgacgtcagaaatgccctggaagaattgcgtacatttatggatattggagagggtacgattgaagagtctcagacagaggataaggactggatcaacaactggaaagaatttttccatcagttctatgtggatgatatcctgatcgttccgtcatgggaagaaatcaaagaagaagataaggacaagatgattcttcatattgatccgggtactgcatttggaacaggaatgcatgaaactacacagcttgtgatccgtcagttaaaaaaatatgttaaaccaggtatcgcacttcttgatgtaggaacaggaagtggtatcctcggaatcacagcgttgaagcttggtgcaggtcacgttgtaggaacagaccttgatccatgcgcggttccggcagttcaggataacaaagaagcaaaccagatcgtggatgatacttttgatatgatgatcggaaatatcattgatgacaaagaggtacaggatcaggttggctatgagaaatacgatattgttgcagctaatattctggcagatgtattggtgcctctgacaccagtgatcgttcaccagatgaagaagggtgcatattacattacatcaggtatacttgatgtcaaagaggaagtagtcaaagaagcagtacagaaagccggacttaccttggtagaagttaccagacagggtgagtgggtatgcgtaactgcaagaaaggactgatctcatgcagagattttttgtagagccacatcagatcgatgaagcggcacatcagattcatattattggaacggatgtcaaccatatttccaatgttcttcgtatgaaacagggagaggaagtctggatcagtgatggtggacaaaaagaataccgctgtgcgatagaggcattcagtgcagatgaagtgcttcttcacattatttatgcacaggaaccagattatgaactgccgagcagaatctacctctttcagggactgccaaaagcagataagatggaactgatcatacagaaggcagttgagcttggtgcgtatgaaatcattccagtagagacgaaacgctgtgttgtgaagctggatggcaaaaaggctgcgaagaaagtagagcgttggcagcagattgcagagagtgcggcaaaacagtccaagcgtatgctgattccaaatgtgcatcaggtactttcttttaaagaagcactaaagtatgcggaatctatggatattcgtctgattccgtatgagcttgccaaaggcatgcaggaaacaaaagaaatccttgcagcaattgaacagggacagtctattgggatttttatcggcccagaaggcggttttgaggaaaaagaagtagaagctgcaatcagcgaaggggcaaaaccaatcacactgggtaaacgtattcttcgcacagaaacagcagggcttgcaattttgtcagttctgatgtttcagcttgaaaattagtaaaacaggaaacgattaagataaaagaggcagtatatggaagtatattttgacaattctgcaacgaccagatgctatgattctgtaaaggatatcgtggtaaaaacgatgacagaggattttggaaatccgtctgccatgcatctcaagggtgtagaagcagagaagtatgtaaaagaagcgacaaagaccattgcaggaattctgaaagtgcaggaaaaagaaattctgtttacatcaggtggtacagaatcagacaaccttgcgctgattggtggtgcacttgcaaataagcgtaacggaaaccacatcattatcacatccgtagagcatgctgcagtcagccagccggcattatatctgcaggaacagggatttgaaatcacatatcttccggtagatgcgcagggcagggtaaaaatgagtgcgctggaagctgttttaagaccagatacgatcatggtatctaccatgcttgtaaataatgaagtcggagctgtgatgccagtcgaagagattgcgaagatggtacatgagaagagtccaaaggcactgtatcatgtcgatgcaattcagggatttggtaaataccacatttatccgaaacgtatggggatcgatcttcttgcagtcagcggacacaagattcacggtccgaagggtgtcggtttcctgtatatcaacgaaaaagtgaagatcattccacagattcttggtggcggacagcagagtggcatgcgttccggaacagacaatgtaccgggaatcgccgggcttggtgtggcagcaggacagatttaccgaaatctggatgagaatgtggaacacatgtatcagttaaaggagcatattgcgaaaggcctttctgaaatcgaagatatccgtatcaacggaatggcacttcgtgaaggtgcaccgcagatcttgagtatcagtgttatgggagtacggagtgaggtattgctgcattctctcgaggacaagggtatatacatttcggcaggaagtgcatgctccagccataagagaaaaccaagcgctacattaagtgctatgggaatgtcaaaagaccagattgaaagtacagtacgactgagcttctgtgaagaaaatacaatcgaggaagcggattatttcctggataccatgaagactctggttccgatgctcagacgttattcaagaaaataaacaggaggaaataccagatatgatatttcatgcatttttgataaaatatgcagaaatcgccattaaaggaaaaaacagatatctgtttgaagatgcacttgtcaaacagatgaaactggctctggagccggtagaaggcgaatttacagtaactaaggagcaggggcgtgtatatgttttctgcccggaaaaatatgattttgatgaagcagtagaggcactgcagcgtgtatttggaattgtgggaatcagtccggttgtgatctatgaagaccagggatttgatcagatggcaaaagatgtcgtttcctatatggaagcaagatatcctggatacaatggttctttcaaggtttacacacgaagagccaagaaatcttatccgatcacatcgatggaagtaagtgcggcaatcggagaaaagattttggatgctttcccagatgcatccgtagatgtgcataatccggaaatgacactttcagtagagattcgagataagatttatgtatattcagagacacttccgggaccaggtggtatgccgattggaacaaatggtaaggcaatgcttcttctttccggcggaattgatagtccggttgctggttatatgatcgccaaacgtggagtcaagatagaggctgtttatttccatgctccgccgtatacaagcgaacgtgcaaaacagaaagtcgtagatcttgcaaaacttgtagcacgttacagtggtccgatccgtcttcatgtagttaactttacagatattcagctgtatatctatgatcagtgcccgcacgaagaactgacgatcatcatgcgccgctatatgatgcgtattgcagagcattttgcacgcaaggataaatgccttggcctgattacgggggagagtattggacaggtagccagccagactttacagagtcttgcagcaacagatgaagtatgtgaacttccggtatatcgtccggttatcggatttgataaagaagaaatcgtacagatttccagaaagatcaatacatttgagacttccattcagccatttgaagactgctgtactatttttgtggcaaaacatccggttacaaaaccaaatctgaaagtgattcacagatctgaagaaaaattaaacgaaaagatcgatcagctgatggaagaggcactggcaagtacagaagtaattgagattcagtaaacagaaacgaaataggcagaaataaaaacagcttctcatgcgtttagcaaagaagctgttttataactgtatcatatttggtatttcaaaagaaaatcggtgcagatcactcaattacatatggctgaacgattgccatgatcgaatcaagagtgcttccttctgcatgaatattcaggttgatcggtttggataaatccaggctgaagatacccatgatggatttggcatcgattacatatcttccggatactaaatcaaagtcacagtcaaatttactgatctcgtttacaaatgctttcactttatcgatagaattcagcgagatttttaatgttttcattttgagaacctccctatttagtgttattatgccatttatcttacccgtaccccctcgaaaagtcaagggaaaaagagatgaaattttggttaatcttttgcctgtatgtacaaaaaaacaattaaaataagaaacaaaatgaaactatcagaaaatataagaggtaaaatatgaaaaaaaaggttgcccttcataatctgggctgtaaagtaaatgcatacgaagtagaagcgatgcagcagcttctggaaaatgcaggatatgaaactgttccttttgaagaaggtgcagatgtttatgtgatcaatacctgtacggtcaccaacattgcagaccgtaaatccagacagatgcttcataaagcaaaaaaaatgaatccggatgcgatcgtggtggctacaggttgttatgcacaggctgacacagagaaactgaaagaagatactgctgtggatctgatccttggaaacaatcagaaaacacagattgtggaagctttggaagaatatgaaaaagagcatgcaaaacaggtgcaggtgattgaaattaaccatacaaaagagtatgaagaactttccatatcatctaccgcagaacatgtccgcgcatacattaaagtacaggatggctgtaatcagttctgtacttactgtatcattccgtttgcgagaggacgtgtccgcagcagaaaaatcgaagaagtgctgagtgaagtggaaacacttgctgcaaaaggttacaaggaagttgtacttaccggaatccatttaagttcctatggagtggatttcccgaaagaagaaagagaaagtcttctttcactgattcaggcagtaagcagagtggaaggaatcagcaggattcgtcttggctcattggagccaagaattatcacagaggaatttctggaaggtattgtgaaaacaggaaaagtgtgtccacattttcatttatccctgcagagtggatgcaataaaactttgaaaaatatgaatcgccgttacagtgcacaggagtatgcggaaaaatgtgaactgatccgcaagttttatccggtacctgcacttacaacagatgtgattgtgggatttccacaggaaacagaagaggattttgaagaatcttatgaattcgtaaagaagattcatttttatgagacgcatatttttaaatattccagaagacatggaacaaaagcggcatccatggatggtcagctgactgaagcggcaaaggcgcagcgcagcgaccggatgctcgaactgcatgagattcgtgccagagaatatgaagaggcgatgatcggaaaaaaaatggaacttctcctggaggaagagattgagattgatggcagaccatggtatgttggccacagcagagaatatgtgcgtgcagtcatcagcaaaacggatgcacatagggtaaatgaccttgttacagtaaaagcagttgcttttgtcagagatcacattttggaaacaaaagaagtgtaagcttatatattatttgatctatgagaaaaaaatgttctgaaaatgtgttcttgtattttatatggaattatattaaaataaaagggaaatcttattaaggacgtgagtaaaatggcagaaaacaatttaggaaatacacagtatttcagaacaaaaccggatgcagatcttgaagtaaaagaggttctggacctggtctacaatgcaatggatgaaaaaggatataatccggtgaaccagatcgtcggctatattatgtccggagatcctacctatattaccagtcataagggtgcgagaagcatgatcatgaaagttgagagagatgagctggtagaagaacttcttaatgaatacattaagaataaatcctgggaacgataagtgatgcggatcctgggattagattatggttcaaagaccgtaggtgtggcagtcagtgacccgttgggagtgactgctcagagattagagacaatctggcggaaacaggaaaataaacttcgccggacgcttgcccaagtagaagaactcgtgaaagagtacgaaatagaaaagatcgttcttggatatcctaagaatatgaacaatactgtcggtgagcgtgcagagaaagctctggaattcggggagatgcttaagaagcgtacaggccttgaagtgatcatgtgggacgaacggctgacaacagtttcggcggatcggaccctgatggaggctggtgtgcgcagagaaaatcgtaaagagtatctcgacggaattgcagcagtatttattttacagggatatctggattcccttaaaatgtaacataaaggtgatagtatggaaaaaatcagatttcagctggccgatgggacagtagaagagttttttattgaggaacagacaagaatcggaggagtatcgtatcttcttgtatcggattctatggaagatgaagcgtctgcctatattttgaaggatgtatcgaaggatacagatccggaggcctgctatgaaatgctcgaagatgaggacgaactgcaggctgtttataaagtttttgaacaaatgcttgaagacgtggattttgaaatgtaagaaacatactataagaaacaggcgtcactaggaacgtaagaatcagtgacaggcagactaagaaggaatgtgggcgcattcctgcattagtgtgccaaaatgtttgattccagaggacacatgacaggtgttttctgcattgcacagaatatggaggtgcttgattgagcgaaaatataaatgaaaatgtgagcgtaaataaagaaagagaaaatcacagagaatacaataaaaccagaaaatataacagccgaaatcgtaaaccgggtgataataatacaaagaaaccgatgggaaaacagaaaaatttccgttataaacagcagaaaacgaatagcagacattatgagaaacattctgacagacaggaaatagctgctgcaggagaattagcagcagtacagcagccaaaggcagcaacgaagccgttttccagaaacaataaaacacaacagccaagaggaaatgcgcgtcgtggccgtaagggtacttcaaaactgaagatcattccgttaggtggactggaacagattggaatgaacattactgcttttgagtatgaagatagtattgtagttgttgactgtggtcttgctttcccggaagatgatatgcttggtatcgatctggtcatcccggatgttacttatctgaaagaaaatatttccaaagtaaaaggctttgtgatcacacatggacatgaggatcatatcggtgcgcttccttatatcctgaaagaggttaatgttccggtctattcgacaaaacttacacttggactgatcacaaataaactgaaggaacacaaccttgtacgttccacaaaactaaaagaagtaaaacatggacaggttatcaaccttggtgatttttccattgaatttatcaaaacaaaccatagtatccaggatgcttctgcactcgcaatttattcacctgcaggaattgttgtccatacaggtgactttaaggtggattatacaccggtatttggtgatgcgatcgatctgcagcgttttgccgagatcggtaagaaaggtgtacttgcactgatgtgtgacagtacgaatgcagaacgtccgggatttaccatgtcagagcgtacggtaggacatgtattcgataatctttttaatgaacacaaaaatgcacgaatcatcattgcgacatttgcatctaatgtagaccgtgtacagcagattattaataccgcatataaatttggacgtaaagtagctgtagaaggacgaagcatggtcaatatcatttccgttgcttctgaactcggatatcttcgtattccggaaaatactctgatagaaattgaccaggtaaaaaattatccggatgaaaaagttgttctgatcacaacaggaagccagggtgaatccatggcggctctttccagaatggctgcgaatatccacaagaagattacaattaaaccgaatgatactatcattttcagttcaaatccgattcctggaaatgagaaagccgtttccaaggttatcaatgagctgtccatgaagggtgcaaaggttattttccaggatgttcacgtatccggacatgcctgccaggaagaaatcaaactgatctattctctggtaagaccaaagtatgcgattccggttcatggtgaatacagacatctgactgcacagaaacatgtcgtagaagatcttggtattccgaaagagaatatctttatccttgcttccggtaatgttctggagctggatgcaaacagtgcagcagttaccggctctgttcatacaggtgcgatctttgtagatggtctgggggttggtgatgtcggtaatatcgtacttcgtgaccgtcagcatctgtcagaggatggtatcatgattgttgttatgacacttgaacgccacagcaatgtggttcttgccggaccggatattgtatccagaggatttgtctatgtaagagagtccgaggatctgatggaagatgcaaaagaagtcgtagaaaatgcgttagattcctgtctggaacgtaacattacagattggggcaagatcaagaatacagtaaaagatgcactcagtgatttcctgtggaagcgaacaaagagaagtccgatgatcctgccgatcattatggaggcataaataacatggatgctgtaaacagaaacattcatcttcttctgaattctatccagaagagcgatgtatacagaacttacaagaaacaggaggcaatcctggaaaaaaatccggaactggtctcgagagtgcagcatttccggtcagataacttccggcttcagaatgaagaaagaggaaatttgcttcaggatgcggaacagctggcacgagaatcagcagaacttcgaagaaatccggaggtaaatgcttatcttgatgcggaactggcactttgcaggatgatgcagcagatttgtaagacattgacagatggaattgagatcaaggtgccggaaatctgagcagtgcagtttgatgagatataatcagtacacagaaaggagcagatatgggagataccaaagaccgggtaggcgcggctggagtgatcgttgcaggaggattttttaaaatagccttgtatgtttgtgtggctgtcctcgtgatctggatcggtaaggttacctaccagtttgggtataacatttttaaccagcaggcgatgaatccgggagaaggacaggaagtaactgttgtgatcaaagaagatgcaacaagttatgatatcgcaaagacattaaagagtaaaggactgatcgaggatacgctggtgttctgggtacaggaaaaactttcaaattacagtgggaaaatgaaaccaggcacatatctactcagtactgcctatacaccaaacagaatcatgggaattcttgcaggtgatgcagagcaggaaggagcaacttcgtgatcgtagaagagagaatgcgtacgtttattaattcccttgatgcagggaacactccatttcttgatgaactggagtgttctgcgttgtctgagggagttccgatcattcgtaaggagatgcagagctttataaagacactgctggcacttaagaagccgcagcgtattctggaagtggggacagccgttggcttctccacacttcttatgtgtgagtacagtcagcctgaaatgcatatcacaacgattgaaaattatgaaaagagaattccaaaggcaagggagaatttccgaagagccggccgtgagtcgcagattacctttttggaaggagacgcagggcaaattctgaaagaactttcgggatcatatgatctgatttttatggatgcggccaagggacagtatattcactggctgccagatgtggtgcgactgcttgccccgggcggagtcctgatgtcagataacgtacttcaggagggcgagctgattgaatcccattatcttgtggaacgaagaaaccgtacgatttacaagcgtatgagagagtatttgtatgaactgaaacaccatccacagcttatgacaagtattattccgctgggagacggcgtgtctttgagcgttaaggaggaagcatgagaaatatagagttactggtacctgcaagcagtcttgaagtactgaaaatagccgttgtatttggtgcagatgcggtatatataggtggagaagcatttggcctccgcgcaaaagccaagaattttacacatgaagatatggcagagggaattgcgtttgcacatgaacatggagtaaaggtttatgtgacagtaaatattctggcgcataatgatgaccttccgggagtcagagaatatctgcaggagctgaaagaactgaaaccggatgcactgatcattgcagatccgggaatttttacctatgcccgtgaaatttgtccggagatagaatgtcatatcagtacacaggcaaacaatacaaactatgagacataccgtttctggtataagctcggcgcgaaacgtgtcgtaacggcaagggaactttctttgaaagaaatccgtgagatccgtgaacatattccggatgatatggaaatcgagacttttgttcatggagcaatgtgtatttcttattccggaagatgcctgcttagcaattatctggttggaagagatgcgaatcagggggcatgcacacatccgtgtcgttggaaatattctattgtggaagaaaaacgtcctggtgaatatatgccggtatttgagaatgagagaggaacttatatcttcaactccaaggatctctgtatggtagagcatatggatgatatcctgaacagtggtatcgacagcctgaagattgaaggacgcatgaagactgctctttatgtggcaactgttgcaagaacttatcgcaaggcaattgatgattatatggaggctccggaaaaatataaggcaaatatgtcctggtatcaggaacagatttccaattgtacgtaccgtcagtttacgacaggattcttttatggcaaaccagatgaacatacgcagatttatgacaacaatacgtatgtaaaagaatatacttatctgggatatgcagaagaagttgatgaaaatggtttcgcacatattacgcagagaaataagtttactgttggtgagatgattgagatcatgaaaccggatggcagaaatatcacagcaaccgttcgtgcaatctatgatgaagatggaaattctgtagaaagtgcaccgcatccgcagcagaaacttgccgtagaccttggaacagagattgaaaagtatgatctccttcgaagggccgaggcataaaatacagacgaatctgtaaaacagaacttagaataaaaagagagcagatatcctcatgagaagtgatatctgctctttttttatttaatgaaaaatttagcgactgcgcacaggggcattcataacaagctgagcgttggcattccactgactagcatttacaggggctgccataacctgaattttagttactttactgcgatatttccatttcgcaagagacgtttttaaacggacagtttgatcagcaggtacaattctggcacattcgaagatatgttttccactgtaaaagcgcaatttgatctgtacatatccattctgtgcaccacttgcgcggagcgttgtgcagaaatttggatatgatttaaaggaaagactgcgtttcattttttgtgagaatccccataaactgtttttgtttcggcggatatcatgaagagcagtaaaggtatttcctgttttatgtgaagttgtaacagcaccataaggagaccagctctgatatatggaagcaccgcggcgatatgcatttacctgttcaagtgctccgatggtacagtttgatttgttatagagtttggaactgtatgaaggaatcagcgatttccagttgctgacaccgatcgtggatggaataaatgcggtttcggaagcagaacgactgctgtccatatatttaaagacactccaggatcttttcttggtgttggcagattcaaaatcagcagatctggcgtcggttgtccataatccaagattcagtccctgtttgatctcttctttgtggtcaatctgacgatgaatgatcagtgagtcgatcatattatctgattcagcaagaaggtaactgtaggcaaccgcagctgcctgcagattttcaacattgtgttttctctgaacagaagtataaccggtctcggacagaatgatccttgtttttgaaccatatttctgacgtatatagctggtcagcaggcggatatttcccatattgatcacaggcgttgtaagtgatttggtgagctgcccgtttgtattcgcccagaaacgaggctctgtcagtggagaactgtatgggtgatatgcaaggttccattgcagatttccaccggcacgtatctttgaagcaaaagaatccagcatttttcgtgaagcaaaggttccattcacataatttgtattccacagatgatcaagtgaaatataaactcttgcattagaataaacactgaccagtgtattataggcaagacgaaactgatctgcataaatctgagaatactgtctcagtgtctgggaaccggcgtaattataagtgttgtaattattgacttcatttccgatgatccagttggaaatctgtccgtatttttttgtggaagtactgtaacgtctggccagaaaattcagtgttgcctgcagctgctttctcgcagaacggtctttggtattccaggcataaaaagcatgtccctgctggcgtccttgtggatagatcaggctggtcaggtcactgcgccaactcagaagcagaacagcagaatttacagatgaagtggaattcagtgcaagcagctgtctgtcgtaataagagacagaatcttttacaaaccagtaagtttgtccctggtatttccaggagtaagagtacctggaattttgaagtgccggtggtgcgatcagctgactgaaatcaatattgatcacagaatttcgtacattcagttcttccgcatcttccatcatgtcagcattgacctgaagtccctttttggagatggactttggaaaacgatatcgatatttggccagtgcaccggggttggaaataaatctgcgtgtgctgatataggtatatttcccactggaattccgagaagcgacagcaaaaccggaattcagaaggttgacaccaccggaatttaatttacaggtaaatgtcattttttttgattttttacaggatgctactggcctggccgacatgcccggagtcagtgcaaaaaggtaacagcgagatccggatattttacgtggatttgccgtgacagcggttacgcggactttgctttttcctgaaatcttacagctgctgatcgttacaggccgtgaggctgcagagaccgaagcgggtgcaaaacctgttccgatcaaaacagtacagagcagaagaatcagcagttgtttcaatagtttgtgcatatatacaaagcctgatcgttcagttgtatctgtcatatgaatagaaaacctccttccgactgaagacatctcagtctgtttctaattttagagtatttctgacagaaaatcaaccgaagagagtttttaatttttttaatgcgtttttttcgattctggagacataggaacgactgatatgaagctgatcggcgatttcacgctgtgtcatttcgttgttttcaaacagtccataacgacagcagatgacctggtattcttttggtgtcaggatatccttcatagaagaaaaaagaaatcgtatatcctgacgggtagaatattcttctacgatatccaccggcggactttcgataatatccagcaggctgatctcatttccctctttgtctgttccgatcggttcataaagagaaacttcacgtgaacatttttttcttgcacgcagcatcataagaagttcgttatcaatacagcgggcggcataagtggacagcctggcagaacgttctgaattgaaggtggaaatagccttgatcagtccgatcgtaccgatagagatcagatcttccagttcttctccgtttccctgatatttttttgcaacatgggcaaccagacgaagattacgttcgatcagaatacgttttgcttccggatccccttcctggcagcgtctgaggcagagccgttcctctgctgcggtcaaaggtttctgaaaagttttcaaatatccacctcaaaaggggcttctatatagaatatgtcagaggctggagcaacgtgcttttcccataaaattatatgatttgcgtatcctcaggatgtagtgtataataaattttatatgagaaaaatacacttttaaggataatcaggtgaactattttgaaaaaaaagatagaacagatactcaatggaaaattcaaatatgatcagccggaactccttttttcaaaagaaaaactggagataaagatcaaagcaggaacgactacacagggggagctgtatcttggaacggagaacaatgataagatacagggatatattacttcctcagatcgaagatttgttccgggaaacagtcggttttcgggtacaaccgtacggctgccttatggaattgacgcagtgggaatgcaggctggtgatatatgcagaggctggctctgtgtgacttccagcataggagagtacaagcttccgtttgcaattgaggcaataaaagaagaaatcataagttctgtaggaaaagttgatgatatgcagacattttgcgagattgccagaaaagattttcgagaagcttatcatctttttaccgaaaaagatttttgtatgatgttcaggaaagcagacaaaaagcagaaagcgttgtatgcaggtctatccggacagccagtaacttatcagcatctggaggaatttctgatcagtctgaaggaaaaagatcctgtttccgtatccttaaaaactaccgcagcagaattttataatgtagaagaagatatgcaggaatcttttgagatacacagaagcggatggggacatcttcgacttgagatcgagacaaagggggagttcctggagccagagcgtcatgtgataacggatgaggattttattggaagcagtgttcagatcaactatcttgttcatgcagatcagttaaaaagagaaaatcacataggcgagatcattgtaagaagtccgtatcaggaactgacgtatcatgtccttgcatcgaggggagcgcgcattcatattgatgtacacagagaagaaaaaaggcacaaacttgcacttgtgaaggattatcttgaatatcaggaaaacaggatcaattttcagacatggaaagaaaatgcagggtttgaattaaatcagctgagggaagcaggctgcgaatatccggagtaccagtttctggaggcatatatggcacatctggacggaaaagatgatgtggcaaaaaaaatcctcaagaattttcacggtaaagaatttacaagagaagaactggaaacagccggaacttatctctatctctgtacagtgaccggtttgtataaggatcggggacaggcagtatggaaattgcagaattttttcaggcagaaagaggacagtttccagcttttgtggctgttgcttcaacttgacagtacatatcgtaccacaccatcgaaagtactgttcatgatggaagaactatatgaaaaaggctgtacaagtccgcttctttatatagaagcctggaagatgatcagtgaggatgtttctctgcttcatcgtcttaccccgttctggatgcaggtattctgctatgctggtaaacatgatctgcttaccgaagagcttgtgatgcgtatggcatatctctccggatatgaaaaaagattctatggaagtctgtatcaggcgcttgcagccggatatgagaaattttcatcagatgatgtgctggaggctgtctgcaaatatatcatgaagggggaaccacgcagaccggtatatttcaaatggttctcgcttgcggtaagcagaggattacgtatcaccagattatttgaatattatgtggaaaccatggatattacatatagaagacagctgccgaagccgcttctgatgtattttgcgtacaatgacaattcacttggtgatgcacgcaaggcttatgtatatgcgagtgtgatcgcatttaaagaaaaagatccgaaaacatatgaaaattataaggataatctggaacggtttgcctatcgcaaactcagagaaggacagatggatgaaaattatgcgatcctgtatcaggaattcctgtttgatccggtaagtgctgaagatggagaagcaatcgctccgaagatgtttacctatcgtctgtactgtgatgacagcaaaatccgacaggtgatcgtgcggcacagtcagtttgcagaggaagaaatctacccttgcaataaaggaattgcatatccgagaatctatacagatgatgcggtgatcctgttccaggatgataagcagagacgttatgtttctacaatcccatacaatcttacaaagctcacagatgaaagcaaggcagtaccggaacttctggaactgggagtcagagaacggggacttctgctgtattattgcgaatcgacaacgctgaatgcggataatttggagtattttcagagtctggcagaacttgaggactgtacagaagagtatagaaattctgtaagaaaacagattctggattactatgctgcgaatgttcaggatcagaagcttgataaatatcttgaaaaaatggatttccgtcagtatgcacaggttgaccgtacgacactgcttgaagtattgatcaccagaagaatgtttcgtcaggcaatggtgattgtagaagaatttggttatgaaggactggatctgagctgccttctcaagatgacaagccggatgatcctgaaaagtgacatggcagaagatgacgaacttctggcactggcatccgaggtttaccggaagggtaaatatgatgaagtgatcctgcattatcttatgctgtatcggtttggaccactggatgaacttatttcgatatggaagagtgccagaggattcgaaatggatacgtatgatctggaagaaagaatcttaagtcttctgatctttacggaagattaccgtaaagagggggaagctgtactggaatcttatgtgaagcagtccggaaaagaacgaatcacaggagcataccttacactggtttcttatggtgtttttgtcagagaatatacaatgagtacgttcatcagaagcaggctggaatatgcatttaccagtaagtggccggttaatcttatctgcagactggcgcttctgcaggaaatttccagagaaaaagatccaaaaccggaatatgtgggaatagcacagagcatactggaagagtgtgcaaaagaaaatctgaaatttgcgtttttccgcaaactctcaccggaacttttgagtccatatcagttggatgacaaaacatttgtggaatgtcgtgcagtacctggggcaaaggttacgttgttttacagactggataccggacttggagcagagacagcatataaatgcgaacctttgaaagaaatgtatcagggcatatttgtaaggacatttactttgttttacggggagacactgcagtattatttccagatcgatgagggagataaagacaatacaaagaagacttcggaacgcagcgtttcaatgaaaaaagtcgagggtgcctctggaagcaagtatcagatgctgaatcagatgttgtctgcaagaagactggacaaaacgcaggaagtgacagacagtctgaaagattatctcagacaggaacagtatgtgaaaaacatgtttagcatagagaaggaaagcggaagatgaatgaaacaagagacttgataataggaattgattttggaaaagaatattctcagatctgttattatgaccgcaaggcagaggaaccgcgttcacttcccgtaaaagtgggaagcagccagtttgaaatgccgacctgtctttgcctgcgcccagaccgcaagacatattgtgcgggattggaagcagaatattttgcaagagaaaaaggtggatttctcgctggaaacctttatgagatatcagcacagaacggaccggtagcggttggaggtgaaaaaaaagaagcatgggagcttcttgcacattatctgcatgagatgctgaaacttacagggattgcggaagtagaaaaaaacatccggagtctgtcgattgccatggacagtctgaatgctgtacaggtagaaaatcttcagcgggcatgcagagaactgggaatcccggaagaacgtacgattcttctggattatgaagagagtttttattattatgttatgacacagaagatagaaacctggaacagaagtgtaggctggtacagctttgaacagcagaaggtaagttttcgacgcatgtccatgaattcaggaacacgaccggtactggtacatctggaagagcctgttacaacgactctgagtgcgaaggtagaggagcgggatgcagaattctatacatttatcaagaacacacttggtaaagaattgtattccagtattcagatcaatggagagggatttgaccaggaatgggcacagaaatctgtgaagctgttatgttatcagagaagaaaagttttttatggaaataacctgtttgcaagaggagcctgcagcgcaggagcagaacgggtgatcaatcatgacctgaaagactatcgttatatgagcagttcgctggtactttctgatgttggaatggagctgcgtgtcatgggagcaccggcttattatccgttgatcgaatcaggcagaaactggtatgaaagtaatgcatatgtcgagctgatcctggatggaacgaaggaacttgtttttattgtagatacaatgggcgaggcaaaaaagaaacggatcgcaatggcattgccggggctgccggagagaccagagcggacaacgagacttggtgtgaatctgcagtatacttcacaggatgaatgcagggttacagtaaaggatcttggatttggtgagatgtttccatcaagtggcaaagagtggacagaaacgaccagatggcaggaggagacaaagtgagcggatatatactgtgtcagacaaaacgggcaaagctgccttatttcatagaaaatatcagtaccaatgtgtattccattgaagaactctgctattatttgtatcataatctgtatctgatcgaccagacgatcatgaatgagggattgtgcagctggatacaggaggaactggaacttccggcactggcagccaaacttcgttccaagatcagcaaatttgcaagtgcggaagatattgtttatccggtatttaaagaaatcaattatctgacatatgaagaactgaaagaactgaatgtacgtttgcagaagatgaatgaagaaactccggcaatgcgtgagaaacagaaggcagatgcattaatggagaatgaaatgtatgtacatgcgatacaggtttaccagaatcttctggaaagggaagatcttgaggaaatccgtgaggggatgacagaaaaagtgtaccacaatcttggctgtgcttacagttatctgtttcagatggaaaaagctacagagtattttcgaaaagcatacgagggaagcaggagccgggaggcactggaagcttatctgatcgcttttggaatgacaagaacatcttcagaatatgaaaaaatggcaaaatcaatagggacagagaaggaagttctgcagaatatccgagagagacttcaggagttttccaaaacaccggagctggtggtgaataagacaaatatggacgaaatactcaccagactgacacgagaatatcacagaagtacgggttcgtgaaaattgtaacaatgtatacagtttttttgcacgattatagtagacgaaacagatttaatctgttaaactagatttataatttgggtttggtaataccacccaaaaagattaggaggaatttatcatgttagtaaacgcttcagaaatgttgaaaaaagcaaaagctggtcactatgcagtaggtcagttcaacattaacaaccttgagtggacaaaagcaatcctgcttacagcacaggaactcaactctccggttatccttggtgtatccgaaggtgcaggaaaatacatgacaggttataagactgttgttggtatggtgaaaggaatgctcgaggaactcaatatcacagttccggttgcacttcacctggatcacggcagctacgaaggatgcctgaaatgcgtagaagccggtttcacatctatcatgtttgatggttcccattatccgatcgaagagaacgtagaaaaaacaaaagaactggttaagatcgttgcagagcatggaatgtctctggaagcagaagttggttctatcggtggcgaagaagatggtgtagtaggtatgggtgaatgtgcagatcctaaggaatgcaagatggttgcagatcttggtatcgacttccttgcagcaggtatcggtaacatccacggtaaatacccggctaactggaaaggtctgagctttgagacactggatgctatccagaagctgacaggagatatgccacttgtacttcacggtggtacaggtatcccggcagacatgatcaagaaagcaatcgaccttggtgtatccaagatcaatgttaatacagaatgccagcttgcattcgcagcagctacacgtaaatatatcgaagaaggcaaggacgagcagggtaaaggatttgacccacgtaaacttcttgctccaggaactgaagcaatcaaagctacagttaaagaaaaaatggaacttttcggatccgttaacaaagcctgagaagtacactttttataaggtggaaaagaataaaggaatcagtgtctccggacactggttccttttttggcattttcatggtaagatgtttctatggcagaaaataagactattaataaagaacaaaacagaacagagaacaatgaaattgtgatcatgaatttttccggaatttacaaagaacagcagttttaccggaaccatgcagaaatgcaggaagatatatcctggttggaggtacaggatttaccgggaagtaactgttactgtgatgaggaagcgcaaaaccggatactggatgatataaagaactatacgggaaatggcatacatttcattgactcaggaaattatcattatgtaagccggctgtggctgtcaaagatggaacatccattccggcttctggtatttgataatcatacggatatgcaactgccggcctttggaggccttttatcctgtggtggatggattgcggcatctttggaagaagtaccgatgctgcaagaggtaattcttgttggaccggatgaagaggcctatacgcaggttgaaccggaatttcagcagaaagtacagtttttgtccagagaaaagttgctggcaatgacaggtgaggaaaagaatacatttttcaggaatctgcgtgcagatcttccaatgtatatttccgtggataaagatgtgctgtgtacagcagatgcgtcaacaacatggagccagggcgatatgagccttgagaaacttcaaaagtttctggaaatcgtgctgcaacaacagcagattttgggaatggatatctgtggagaatgtgatcctgatgcatgcgagagaaatctattgaatgacagggcgaatcagaaacttcttgaattgtggaaaaaatactttccgcagatccgggagaggagacaggatatatgagaaatgaactgtttactataggaccactgacggtatatggatatggattcatgattgcagtgggcgtgatcgctgcatggattattacgaatcgacgtgcagagaaacagaaactggatcatgagcatgtattttctcttgtgatctggtgcctgttgggaggaatgttctgtgcaaagattttattctggatcacggaatggaaaagtattgtacaggatccacattatattctggatacgatttcagatggatttgttgtgtatggaggtattatcggcgggattctggcaggctgtctgtattgctatatcaaaaagacagatttctggaaatattttgatctggtgatgccatctgtggcacttgcacagggatttggaaggattggatgtctgttggcaggctgttgctatggccgtgagacaaatagcatattttctattacattccagaattcggattttgcaccgaaccatgtggcattgattccaacacagatctattccagtgtgctggattttctgcattttggaatccttctttatattgcacgtcataaaaaaaaggatggacaggtggctgcctgctatctgatcttttacagcatcggcaggtttgtcctggaatttttccggggtgatctgattcgaggaagtgtaggaatgctttctacttcgcagtttatcagtttgtttatcctggtggcaggaatactgatactggtgatccgatcaaagaagaaaacagcaaccgatctataaaagcatttgattgtcataaaaaatgatctgtattcataggctgatagggaagaccgaaatgaccggagcgtgagtataatgcctgtaccggcacagaatcaacagtatgaaaattttattatccgatataaacagaatacacatggtggttttgattatgagtctgatgagaactttcagatcgtaaatgatctgtttgggatttggtatgtaccgatgcagaaggtgccggaactggaactgagtagttattcctactcatccataccacggtgctatacatatatggatacaggtgcattgagtacatctggggtgacagggctgcataatcatccatatctcaaattacagggaaagggaactctggttgcggttattgattccggaatcgattatcttcatccggcatttcataatggcgtgcaaagtaagatttttagtatctgggatcaaacactggaaggcggagcagatggcagaattccgtttggcagagagttcggccgacaacagatcgaacaggctctagcatcagaaaatccctgggaaattgtgccttccagtgatacaaatggacatgggacgagaagtgcagcaacggctgccggatatcggattgaaaaagataatttttgcggggcagcgccagaggcagaaattgtaattgtgaagctgaagcaggcaaaaaattatcttcgggatttttatcttttaccgcgagatatcgatatttttcaggaagatgatattatgctggcaatttcttatgtgctgttcatcgcccaggaacagcagatgccactttccatttgcataggtcttggaacaagtatgggggcacatcagggagagggaccgttgaatgaatatataaacagtattgcagcatttacacagaacgcagtatctgttcctgccggaaatgaaggaacggccagacaccattatttgagagaatttggaccgaatgatacagaagatactgtagaactacgagttggtgaccgggagagtaccagaggatttatgacagaattctggggggactctcccggttcttattatatgacgattcagtcaccgacaggggaaaaactgtcagtcagcacagctttaaagaacagaacgcaggaactgtcttttgtatttgtagaaacaaaagtactggtgaattatgtgccaattgaaagaagaacaggaaacacgctgatctttattcgatttcagcatccagcatcgggaatctggaagtttctggtggaagagaaaataccgggaaaaagcaggtttcatatatggcttccggtaagagggatgatttctgatgaaacctattttttgcagtcatcaccggattatacggtcactgctcctggagatactgaagatgcgatgaccgtcacagcatatcagcatcgggataacagcctgttcattcaggcaggccgtggatacaatgcagaaaatatcgtaaaacccgattttgctgctccaggggtaggaattctgacggcttcaatcggtccgggaaaggagtttgcaccggctaccggaacaagtcttgcagccgcacagacggcggggatcgcagcactcctttttgagtgggcactggtccggggaaatgagccatattttactggaaacagtgtaaaacactatctgagcagaggtgcagtgcgagaggctggggaggtctatcccaacccggagtggggatatggcagagtagacttgtatcatacgtttgagttgctgacgtgagaagataggattggttaaatattgtttagctaatttgagtattgagaaaaagtatacaaaaaaaggcagtaaactttagtatctatgacagcaaaatatttaaggcttacgaattgtttttaagccttaaatttgttataattactaaaaaaataagactgttcgagcaattacagtcggaaaaaggattttcaatacacagatgagaaaacaatattgaaaaccgggcaggaggaatcatgaaaagaggcagtatttttgaactgaatggtatcccgaaatttcaggaagcacttccgctggcactgcagcatgttgttgccatgatcgtaggatgtgtaacaccggcaatcattgtggcaggtgctgttggcggaaatagcctgagtgcaaaagacagagttatcctgatacaggcatctctggttgtatccgcattgtcaaccctgattcagctttttccgattggaaagaagaatggttttactttaggttcaggactgccgatgatcatgggggtaagttttgcttatgtaccaagtatgcaggcaattgcagaaggttatggaatcagttcgattcttggtgcgcagatcataggtggcattgttgcttttgttatgggaatcctggtaaaaaaaatccgggtattttttccaccactgatcacaggaacagttgtctttaccattggactttccctgtatccgacagcaattaactatatggcgggcggaacaagtaaccctgattatggttcatggcagaactgggtggttgcttttctgactcttgccgttgttactgcactgaatcattttggaaagggaatcctgaagcttgcttcgatactgatcggtattctcgtaggatatgtggtgtcgattccttttggaatggtaaatctttcaagtgtcggagaagcaaaagtatttcagcttccacagtttatgcattttggaatccattttgagatttctgcatgcgttgcgatcgggcttctgtttgccattaattctgtacaggccatcggagattactctgcgacaacgattggagcaatggacagagttccggaggacagagaactgcagaacggcatcatggcgtatggcgtgacaaatattctgggggcattgctcggaggacttccgacagcgacttacagtcagaatgttggtatcgtaacaacgactaaagttatcaatcgctgggtacttggactggctgcagcaattcttggagttgccggaatcgtaccgaaattttcggcacttcttaccactattccgcaatgtgtactcggaggagcaactgtttctgtgtttgcttcgatagctatgacaggaatgaagctggttgcatcagcagaaatggattacagaaattcttccattgtcggacttgccgctgcaattggagttggtgtctctcaggcatctgctgcacttgccagtttcccggactgggtaactactatttttggaaaatcaccggtggtgcttgcaacgctgatcgctgttgttctgaatattattcttccgaagagccgcgatgaaaaaaaacacgaaaaagaattaaagaaagaagtaaaagaaaagatccagcaggatcatgaagaatttgaacaggaataataaaatctccactctctgtcaatcgggagtggagattttggactttataagaaattactttgtaatattccaataaagccccaaacgctccgagaggatgcattttattttcggtatacgaattttggcagaccgtcctcgccgagaggaacctctatatttccctgaatgagcggacgggcgtaacggatgaaatcttctgtgacatcatgtccgtcagaagtgatccatgtaagtggaactgttttttcttcattgcagattgcgttgacatcttcaagtccgcataccatctgataattaccttcagagtctgtctggcggataaaagataccattttgcctgtttcaccgttaagagcagcctgaacaccaaactttcctgcagttatggcttccttctggtctgtggcagaaatcagagatgcagagcagcgctgactgacattcagttcaacggaacgggctttgacaccgagacggctgcgtaccagattttcgagatatttgccgcagcctgcaagcattttgtgaccgaaagtatcggttcctacggaactgtcatattcacagataaaagtaccatctgcgtcatggattccctcggagacacatacgatcagattacagttcttttcgaatgctttctccagatccttaaggaagacatcctgatcaaaagcaacttccggaagatagataaacagcggattgtctccatcgtatttgcgggccagtgcactggcggcagtcagccatccggcatgccgtcccatgatctcgatgatcgttacagatttcttttcatatacattggcatcggttgtgatctcgcggacagtggaagcgacatatttcgcggcacttccgaagccgggagtatgatcggtgtgtacaagatcattgtcgatggttttgggttctccaattacgcggatagaacttccgatgtgttcggcatagcgtgaaagtttgctgacggtatccatggaatcattgccgccaatatagaagaaccagccgatatttaattcttcaaattttttaaaaagagccgggtagaccggatcctccagagattccggaagcttgtaacgacaggaaccaagataggcgcccggagttgatttgagtccgttcagatcttcgcccggaagagcttcttcgaaatcaagaatacagtcatttaaaaagccttcgataccatttatcataccatatacatgttcgatcgtgtcaggatgggagagaccttcagaaacgacaccgtagagactgctattgatgacggcagtcggtccaccggactgtccgacgataagatttttttttgccattgattatatacctccgattggactgataataggttactgtgtacagtaacgacaatgagttcattttatcatatctgttgaaaatctcatagccattttttcgcaaaagtgataagatgataaaaaaataaaagaaatgatttgattacgtacagtgcagaagaatatggtataatataaaacatgcaggtacatactggaggggatgtgtttccagcataagaataagccattttaaggagtatgattatggaagaaaacaagaacggtacacaggaacagcctgaacagaagaaaaaaaagaaaagtgatgtgattcttacgatagcactggttgtggcgatcgcagtgttctgttatgcagcctacaatctgtatcatatctatacagaatacagaaaaggaacgaatgagtataattcaattgaagaaatggcggttacagaacgtgatccggacagtacggaagtagcaggaccggacgcacagccgaaaccgccaatagatgttgattttgaaaaactgaagagtataaatgatgatgtgattggctggatctacgtagatgcactgccggatatcagttatccgatcgtgcagggaaaggacaatcagacatatcttcatcagacctatgagaagaattataattttgcaggaacgatctttgtggattacgaaaatggcagagatttcaatgactgtaatacactggtctacggacataacatgaaaaatggatcaatgttcggacatctgaagaaatttacggaagatgaaaagctgtataacaatgacagatacttctggattctgactccggataagaattatcggtatgagatcatatccgcatatacgactggagtgaacagtgacacatatacattgttcaaaggccctggagaggaatttgaagaatatctgaaaaagatcaagagttattcggatattaaaacagaagatactgaactgacgatcaaagataagattgtaacactgtctacctgtacaggaaatgaatctacacgatttgttgtacagggaaaaagagtcaatgccgaggatgacggaagtggtgagaatgcgggaagtgctaacagtgatgctgcatcggtagacagtgtgactgtacaggagggatgatcatggatgaaaaaatcgtgaaactgcaggaactgatcgatcagcatgacaacattgtgttttttggaggagcaggtgtatcgacggagagtgggatcccggatttccgttcccaggacggactgtatcatcagaaatatgattttccaccggagatgatcctgagtcatacattctttctgaatcatccggaggaattttacaaattttacagggataaaatgctctgtgatactgcgaagccgaatgcggctcatctgaaactggcagagctggaagaggctggcaaactaaaagcggtcatcacacagaatattgataatcttcatcagatggcaggaagtaagagagttctggaacttcatggaagtgtttaccgcaatcattgcatgcgctgtggaaaatctttcgattttgcatatatgaaacacagtacaggagtaccacgttgcgagtgtggaggaatgatcaaaccagatgtggtactttatgaggaaggactggataacgatacgatcgaagaatctgtgagagctatttcgcaggcacaggtacttatcatcggtggaacttctctggcagtctatccggcggccggactaatcgattacttccgtggtgaggcacttgttgtgatcaacaaatcttccacgccgagagaccgcaatgcggaccttcttatcaaagagccgatcggacaggttttctcacagataaaagtgaacaaataatattacgaggagaaaagaaagacatgggacttatctacgacgtaggagatattgttaccctgaagaaaggacatccatgtgggagcaaggaatgggaaatcctgcgagtgggtgcagattttcgtctgaaatgcatggggtgtggacatatgatcatggttccacgtaagatggtagaaaaaaatacgaagaatctgaagaaaaaggaaaactaaaaacgcacatttattgacataaatttatcaaagtggtatacttggaaaaaagaataaccaggcgtggtctgatttggaaaaatcagtttaataaaatccggtgtgaagccggaacagtttaagacagacttctgtgagtatgcataaatgtacaagtcagagaaaacacggtgtatagaggacagagacccatgggtagagatggggctctgtttttgttgctttagaggggaaaatacaaaatggaaagagttgtagatgaaacaggatggaatcagaaaaggtatgatatccgtacatatacagcgcagaatgagcggagcagaagaatcggtacagcgggggagataccggatgaatatatttatataggagataagtgtttcctgaataatgggaaagtgcacggagtgactcttccggcaggatgccgtgtagttgggaagcaggcatttgagggttgccagttccagaaagctgtggagtttccggaaagtcttgtggaaataaaaagaagaggatttgcggggaaccgacgactccgaaaagtagtttttccacataatctggaacggattggagcacagtgttatcgggaatgcagtaatctgaaagttgctgagtttgaaaaaaatagtaaatgtaaagtgatttcagagggaatatttgactcctgtacgaaactggagagagtctgtctcccagaggcagtcaaaagcatagaaaagagagcattctaccgttgtaaagaactgaaggaaatcaacttaccgaattcggtgacagagattggggaagaggctttttatttttgcggaatagaagaacttgagcttccgacaaatctgaaaatcattggtgacagtgcatttttcagatgcaaaaacctcagaactgtttatataccgacaagtgtgcggacgattggccgctgggcatttcacggatgcagcagactggagcgcatagaggtttttcatgatcctgacgaaatcggaccgtggatcattaacaaaagctgtacgattgtatgtcagaagggcagcagaatcgatgcatatgcacaggaatatggctttcagacagagtatgtagagctttcagaggaattagatggataagatcggacagagggcagcctcagtaaaaaggaaaagaataatttcggtattgatttgcatgctgttggtattaaatgttgtctgcctgacagggtgtggtgccggaaagaaatggaaagacggaaaatgtaccatttccattgaatgttccagcattctggataatatggaagatctgaaagaaacaaaaaaagaatttgttccttcggatggatggatccttaaagaaacagaagtctcttttaaaggcggagagactgcatttgatgttctgaagcagatctgcggaaaaaaaggaatccatatggcttccagatatacccctttgtataaaagttattatgtggagggaatcaatcagctttacgaattcgattgcggtaagaattcgggatggatgtacagtgtgaatggtgaatatccaaattatggagcatccagttacaatttaaaagatggagataaggttgaatggagatatacctgcaatcttggatctgatgtaggagataaatatgaaggaaaatgattccttttccatgtgccacccgctattaaacttcttttattttgcggtggcacttttatttacaatgtttaaccagcatccggtatttcttgggatttcttatgcgggtgcatttgtatacggaggattgctgaatggatggcgaaagaccctgaagcagggattgctgctgacacttccgggacttctgatcatagcattgctgaatcctatgtttaatcattatggtgtgacgatgctttattatatagaaagcagcggtaactggatcactctggaggcgcttgtctatggccttgtacttggtgcagtcatgtttatcgtgatacagtggttttcctgctacaatacagtgatgacaagtgataaatttatttacttgtttggcagaataataccggcactttcactggtattgtctatggcacttcgatttgtcccgcgttttctgcgtcagctgaaagtgatacgaaatggtcaaaaggcgatgggacgtgatgtttcagaaggaaccgtcctgaaccggatcaaatatggtttgcagatggtgtcgatccttgtgacatgggctttggaaaatgcaattgagacgtctgattccatgagaagcagaggatatgggctgcatggacgaacggctttttcaatttatcgacttacccgaagagactgtttccttggggctgtgatgggcggactttttgcggtatttacagttggatgtgccggtggagcggcttacgcggtgtatgatccgcggatcgtaatggcaggattttcttttcagggttatacggctccggtaaaagtatctccgcagtttgcaatcatcacatatatctgtttcggaattttctgcttcattccggtatttctggagctttatgaaaactggaagctcagtcagagcaggaaacagatcggtacagagatcggcatgacttaccgccagatctacgaagaactggacgaagtggattttatatacaataatcaggaatataaaggactggaacaggaaggaaaaagtttatgaatattgtagaaatacgtgatttttgttttgcatatccggattgttccagcaaagtacttgatcaggtaaatttgagcatacaggaaggaactttaaatgtcatctgtgggcgaagcggatgcggaaaaagcacacttcttcgtcatctcaaaagtgtacttatgccgcatggcacagcatctggagaaatcctgtacaaaggaaaaagactcagagaaatcgatcataggacgcagagtcaggaaatcggctttgttatgcagaatccggacaaccagattgtgacggacaaagtctggcatgaactcagctttggtctggagagccttggatatgataatgctacgatccgtcttcgggtagcagaaatggcgagttattttggaattcaccagtggttttacaaaggagtggaagaactgtccgggggtcagaaacagctcctcaatctggcagcgatcatggcaatgcatccgtcgcttctgattctggatgaaccgacttcccagcttgatccgatcgcggcatcggatttcctggaaacggtaaaaaaaatcaatcgtgacattggaacgacagtgatcattacagaacatcgtctgcaggacatcgttccttatgctgataaagcttttgtgatggataaaggcaatgtatttcttgaaggcagtccgcgcgagatcggagctgcacttcgggaacagaagcatggaatgtttctttcgatgcctgttcctatgcagatctatggtgcgacagatagcagagatacctgtccgttaactgtaagcgaagggcgtcagtggctggaacgttattgtagagaaaagaacattacagaggaaaaaagagaaaagatcaatgtggattttctgactgttgtaagggagggagaacaacaagacccagacaacaggaaaaatccggcgatccagttgaaagatgtctggttccgttatgagaaggacagcccggatgtggtgcgggatctgtcactggaagttcgaaaaggtgagttttatgcactggtaggcggtaatgggaccggtaagagtacgacgctgtcgttgctcagtcgcgtgagacagccctacaggggtaagatccgactggaaggccgtgatatccgttcttttaaagaccgggaactgtattgcggatgcctgggagtcatgccgcagaatccacaaagcatttttcttaagaagacagtgctcgaagatctgtactccgtgatcggaggaaagaaagaaaagcagtctgcggaataccagatccatatgaagaaggaaaaagcaatcgagggtatcgtcagtctgaccagactggaaggattgctggaccggcatccatatgacttaagcggtggtgaacagcagagacttgctcttgcgaaggtccttctgctcagaccaagaatccttctgatggatgagccgacgaagggaatggatgcggaatacaaagaagagatagggaaaatactctgtaaactgaagcagcatggcctgacgatctttatgatctcacatgatgtggaatttgttgcagagtatgctgacagagtcggacttttctttgagggaaatgttgtgaccagccagaacacaagagaatttttttccggaaataacttctatacgacggccgcaaaccgaatggcacgacagctgttcccggatgctgttaccggaaaggatgtgatcacatgcttacagaaaagcaattagatcagttcctggatgaattctgggaggacagtcagagtgcacagacagaggcagagcaggaaatatcagaggaaaatctggaagaatatgcacttccggctgatgggatgatcatccggcagatggaacggaaaggcaaggtaagcagaagaacctggtttgcacttgtactgatgcttctggtcgtaccgcttcttctgtatctttcagtgagatattttcatggaagaaagtatctcatatgcagcctgatcgtgatcatagcggcaatgataccgttctttatgatgtttgaaggacggaagccgaaggcaagagaaatcatggtgatctctgtactggcagccatcggtgtagccggacgagctgcattctttatggtgccgagctttaagccggttgctgcgatcgtgatcctgaccggtatttcgtttggcggcgaggcaggtttccttgtaggatgcctgatcatgatgctgtccaatatgtttatgggacagggaccatggactccgtggcagatgtttgcgtttgggatgatcggctttctggcaggaatcctgtatcagaaaggaattctgaaagcccgcaaagcagatctctgtatattcggatttttgagtgtattccttatttatggaggaatcatgaatccggcaagtgcgctgatggcttatggaacgataacatggcagagtcttctggctttttatatctcgggtgctccggtggacctggtacatgctttatctacggttatttttctgtggttcctgagcagaccactattggagaaactggaacgtatcaagaaaaaatatggactcatagagtcacagaaagaggaaatcatttgatctatatcagtcatttgcttccagatgaagagatgaaaggactggtcacagagaccggaacaggagtggaaagtattgatttttccatttcggataatctggatcatctgggaaagagaatagaattatatcagaaaaaactggaaaagatgggaaatcctccgctgatacttcatggaccgtttctggatctgaatccggctgcttttgacagtctgatccgtgaggtgacgatgacaaggtttacacaatgttatcaggcaggactggaactgggggcaaaaaagatcgtatatcattccggaatgattccctgtgtgtattaccgggaaggctgggcagatcaggtgagccgcttttttacagaatttctggaagataaagatgatctggagattgtaatggaaaacgttctggatgaggactggtgtcttcttctggatgtatataagaaggtggatcatccgaaatttaaattatgtctggatatgggacatgcacactgttattcggagattccggtaatggaatgggcagaggggctctctccgtatatcggtcatgtacacgtacatgataacgcaggtgacagagattcgcatctgggactcggaaaaggaacacttccgtatcatgaggtgttaaagctgcttcctgtttcgaaagagcggacatggacgatcgaatgttcacataaagaagatgtacttctttgcttacagaaaataaagacagagggattgttatgaatacaatgaaaaagagaggatgtcagattcttgtactgtttatgacagcaggaatgctgacgggatgtggcgatggaactccgaaattagaggatgccctgaaaaaaactgcttcttatgaaatgaagacagtcgaagatccggcttcggatgcacttggcggagaatggaccgtcatggcgctggctcgttccggggaagaggtagatgaaaactattttgaaaaataccgcgcgaatgttgaaaaaagagttaaagaacaggaaggcgtactcagtgaaaatcgatatacagagtactccagagcagttctggctttaaaatctatcggaaaagatccgacagatatcggcggatatgatattgagaagccgctggaagattttgataccgtagtctcacaggggctcaatggggcaatttatgccctgcttgccctgaatgcagatgatccggatgcgaataaagacggagaactggagcagaaatatctggattatattgtagagaaggaaaaagacgatggcggattttcactggatgacaatgccgaaaacggtgatgtagacctgacagccatgacgctgcagtgtctggaaatgtatcaggatgaaaacaatgtaaaagaagtgattgataaaggtgtggagtttctggcagatacgcaggatgatgatggcggttatactgcttacggagccaaaagctcagaatccatttcacagactgtgatcgcactcagtgcagttggtgtagactgtaatgaggatgaacgattccagaaagatggaaaaggactttacgatacactgatgacgttttaccagaaagacggaagcttcaagcacattctggacggagaaagtgacccgatggcaacagatcaggcattttgcgcgatggtagcctatcagcgttaccagaataagaaaaacagcttttttgatatgacagaccacagataaacggaggaaaaaacagtgccgcagaaaataacagaactccaggaacagctggagacgatcattaagggaaaaaaagaaatcacagacaaaatacttatggcagttctggcaaagggacatgttcttctggaagatgttccgggagttggtaaaacaacaaccgcgctggcactgagccgtgttatgggaatggattttaaccgtatccagtttacaccggacgttgttccttcggatgtgacaggttttacgatgtatgacaaacagagcggacagttcctttaccgtccgggtgctgtcatgtgcaatcttcttcttgcagatgagatcaaccgtacctccagtaagacgcagtcagcacttctggaagtaatggaggagggacgtgtgaccgtagatggtgagacacataccgttccggctccgtttgtagttattgcaacagaaaatccggtgggatcatctggcacacagcttcttccagaatctcagctggaccgttttatgatcagtgtgagtatgggctatccggatcatcagagtctggtagaactcttaagagaccggcagaaggtcaatccactggaaaatgccagaaccgttcttacaaaggaagaggttcttaccttgcagcagaaggtccaggaagtttacgtggcagatgttgtgttggattatatagcaaagcttgccgaggcgaccagggagcatgaactgatcacgcttggtctgagcccacgtggaactcttgcactgtgcaggatgacaaaagcggctgcttatatgaaagaacgggactatgttgttccacaggatgtaaaggatgtgtttaaagatgtagcggcacatcgaatgatcctggattcaaaagcaagatatcaggaaaaaacagcatgcgagattctggatgaaattctggacagcgttccggaaccaaaggtagaaggatgatgaagaacaggatcatgtggcttctgtggctgatcggcatggccggagccacagtagtgacaggctcatggctgatggcggcagtgcttctgctttctgcattactgctgatcttatcggcagcagtcaccagtctgggcggcagaaaaacagaaataaaattatccgtgccaagagcagcggagcgaaatgaaaatttccggggcagaatgacccttaagaatcagtcagcatggccagtgttcgggggcagaggacagattttgtgggagaatctttttaccgacgaacacggtgagatcccaatcaccttttctcttggcagcagggaaaaaaggacaatagagtttgaggcctgcagcggctggtgcggatgtataaaagtgacattttctggttggagatgcagcgacttttttcatgtgttttccgtgaagcggaaggctgtgacagaaggtgctaccgttatcatgccggaaaagcagaacagagatttttccttcctcacaagagagggctttgatatggaaagcttccgttattcaggaaactgtccgggagatgacccgggagaaacctatgacatcagggaatatcagccgggagacagtatccggcagattcactggaagctttccggtaagctggatgatatcatgatccgggaaaaaagttttccggtagatgataccgtactgatcctggcagaagcgtttcagacggaacgtgatccaaaaagggctgagacagtggcagaagtcctgtcggctgttttaagagattttatggaaaagaaaatcccgtgtcaggttggaatttatgacagaagcaccggtaaatttcggcaggaaaaagtccggaaggaagaagaccacgaacatgtcctgtatggtttcctgcgatacggaagtgacgaaaagacgccggttaccgtacaggaatatcttaagaatccgggagcacagaattttgccaattatatttatataaccggagatccggaagataaagaggcagagcttctgaaacaaaaaggagaagttactgtaatcggctgcggagtgagcagtggggacaataaaggagagcagatcacatggaaatacggatcacagaatccagaagacagtcaaaaacaaaatacagaaaacagctgtcagatatcctgctggaaactgcgctgatcggactgactgccggagcaggactctggcttgtgcttgagctgttgacggaatccggacagatgatgccgcttcttggcagcgtacttctgaccgcactgatctgttctgtgacagaacgaatggagaaatgcggcatttacataagaggcggcgtggcagcggcgactgcaggaggcctgtttcttctgtacagacagattctggatggatttgcactttactggaataccgtggcagatacatttggaagcagagccggaatttattttacccgttttgatactgcagacattatggcggaagatacagcccgactggtttttcttatttacctgggaatggcagcagcggtcatcggatttctcatcctgagatttcgcatctatgtactggtatttttagaaatttttgtacttccatttatgatggtgctgacagggaaggaaccggaaagtggagtcggcgtggctttctatatgggagtttttctggagatcaattatcttctggcccgttccggcagaaagcgatacagtgaacagagcagcagggccttctggtttggaggcatccttacgggtctggtactcatggcagcaggagtctttctgggacagatcatgccggcggcagattatgcgtcttcggaacttgttgcagaagcaaagcaggaagccctgaatgcggtgaatgatctccggtacagaaaaggaaaaattaattccctgccggatggacagctgaaaaaatgtggagcgtggacagcatcggatgagacggcattgaaagtgaccatggaagatccggagtcactttatcttcgtggatttacgggcagtgtgtatgatggttcttcctggaagagcattgatacagaagatgcctataaacagaaaaatctgttttactggctgcatcaggatggattctacggagaaacacagctgaatcaggcaagaagtcttgtggaagatgatacactttccgataagatttcggggatttcgattgaaaatgtaaaggcagacagtgaatatctctatactccatatgaaatggcagaacttccgtccggttatgaaggggagacatcgcttaccgacagcatgctggaagcaaaaggtttttttggacagaaaaattacagctttcagacaaataaaaaccttgtaaaagattttacggtgcttggggcaagaatctatcaggcgctggcacagggcgatgacactgcttatcgtgaagatgaaagttattataatacatttgtgtacagtcaggacacagagcttccggcttcactggagacattattccgaaaagaactgggagacggtggaaacagggagcagggacataccgattattatactgcaatctcccgaatccgtgcatatctggaaaaaaatatgacctacagtacggcaacagatgtatatacaaaaaaaggtgattttacagaaaattttatttccagatcaaagatcggccacagtgttcactatgcaacagcggcagcactgatgttccggtattatggaattccatccaggtatgtagaaggatatctgatcacaccggaggatatcaaagataaaaaagcaggagacactgtagagatttccggaaagaacggacacgcatggactgagatctatatcgacggtctgggctgggtgcctgtagaaatgacaccggaatattattcagtcatgaaggaagcggatcttaccgcaggactggaggcaaaaggtgcgaaagccgcatcaattccggaagcagaatcggaacctccggcagaagaaaatctccagacacactggagtctgaaactggctttatttggaatagagaaacttctgattttattgctggcactgtttgacacattctgtcttgtatttatcctgactgtctgtggccttcggatccgggcaaattatcgccgtaaaaagctttttacgggagcagatgagcgactggctgtacgtgccatggcaggctatgcaagagttctctatgcgcacggatcagatctgtattcggaagaagtacagcgtcagtacagagaaatcagcaggatcgggcagcgtgcagcattcagtccacatgcggtatcagaggaagaacgaaaaaatacggcgatatgtatcggccggatgaaagcagaactgaaaaaagcaaaaaactggtatgaaaactggatcatgaaatatattgagaggttgtattaattgaataaaaagaaaaacaacagaaaaatcatatctgttctgatcgttctggcctgttttgtgctttttgcaggagtattgtttacaggaatccggaactataaaacagaaaaaaaagaaaatcccgttcagggagtcagcagtgaaagttctttgaagggatatcttggaaaaggttatgcctatgccggtgcacaggataacatatccgcaggagaggaatcctttggagaacaggcgcagttactggaagatacgaaggacgaagaggctgaaccgcaagagcagaagcaggcagaagtgactgccacgccggaagcaacaccgacaccggagccggaaagtcagaatgaggatgaacagaaggcaggccaggagcagaaatcggcagatgactcggatggtgaatggaatgatgattctaaagagaataccattcaatatgataatgcaggagaacaggacgatagcagtcaggaggcagctccggatcagaatgatgacaggaatcaggagggagcacagctcccgttaagtccaacgccaatgccatccccggaaccaacacaggagccggaagaagaccattatccggagatcgcaacagatctgacggatggtgagacagtaaatggtgactatcgtacgttttatgtacaggccacagactggtatggaaacagcctgccgtccacttcactggagatatatggaaacggagaacggctttcttcaaagggtgaaccgtcgacgggagtttttgcataccgactggacctgaatgaaggaagcaacacggtcaatattaaagcgaccgatgaggaaggatggagtacgacacttccgacctttactatttataaaggggaggatggacaggacgaaccggccggcagcattacggtcagtattgaggcgggaacgattggacttggtacgatccttccggcaacatcgattgactattatcagggagaacagctttcctcggtcgttctcagactgttacagaatacaggatttgactggagaaataatggaagtgcgacaggtggcttttacctgaaagccatcgggcgaggcggcattgcatcaggagcagcgatcccggatgatcttatggaacatctgaaaaaagtaaactgtcagttgtccagccatgatgccaactggatcggtgaatttgattttaccatgaattccggctggatgtattttgtaaatggtgaatatatgaatgtaggaatgtcttcctgtttcccgggagacggtgatgaagtaaggcttcgctttacgctttattcaggagcggacctgggagtaggatcagacggtgaagtatggggggactggtaatgaaaaaacacacaataaaaagaccaatcattaaaaagttcataattggatccctttctgcaggacttctggttggaggaggagctatggaattgaatgctgctctttccatggaggtttatgccgcagataccacgcaggagaccgagggggaagaagcagcaccgacagaggcagagacaccggaaccggcagcaccgacggaagctccggaaccggaaccaacagatccaccggcagaaccggaaccgaccaaaacgccggaaccgacggaagcaccctcaccggagccatctgtgacaccggagccttcagaaacaccggagccatcaattacaccggagccatcagaaacaccggaaccatcggtaacaccggaaccttccgtgacaccggaggtcaaaagtaataacacagatctgaaagaattatatatctctagttcggacacctggggaaagggaatcctgaaactggatcctgcattaaataaagactgggacagatacaaagctgtttatgacggcgaacgccagagcctgaatatctggcccgtagcagaagaggaacatgcccagatcaaggtctatgcattaagtggtgtgaaatattctactgtcgaacaggatgagacaatcagggaaacgcaggatgaagaagggcatacttactggaaaatctattttggtgatcaggaaaaagaatccagagtaagattggaggtaactgctgaggacggaaccagaaaagactattatctcacacttgaaatcacagataaaacagctcctgtactcaaaaaagtcagtgcaagcagggtatcttcaagtgaggcatctgtggtatataagacaagtgaacgaggacagtgctattaccgtgtcgtagatgccgggaagaatcatcagaatccggatacctcaaaagaaggacgggaggtccaggcaggaacagatacactgacgattaatggactgtcagaaggtgcaaaagatatcataatcgtagtaaaggacgatgtcggaaatgtcagcgatcctctggtgatccgaattccggatataaaaaagaaaaatccgacaggcagtggaaactccggctcggttgtacagagaccggggtatggcggaaataaaagtgaagcgacacttccgggtaaaggaaataacggagaaggttctctggcaaatctgaaaacggttggtggaaaaggtacttcttccggaaaaagcggaaaaaatgaatcggaagaagagaataaagaaaaaaaactcaccgcctatgccggaacaaataaaaaagattccggaaaaaacggaaagtctgataaaaacgaaaaggattccacaaaaaagaagaacgacaacaaaacagataaaaagacagaagaagcatcaacggatgatctgacagaaagtaaagataaggataaaacatccggagttatttcgggttcctcggaaaagaaagagaagagcattccggaactggtgggaagtaaagttacgaatacgtggacacatatgagatcccttacaaaggtattatccgtgtttgcactggcaggcctcatttatctgatcttctggacaggagcaagacgaagtttcagaaaaatgaaaaacaggaatccattactgcagcgctgagaaagagaaagagaggtaatcatcagatgagaagaacgggaaaatggcttgcagtccttctgtcagtgactatgctggcggaaacagcaccggtttatggcgcggacatatccgtagaaagtgatttttcatcagagatatccggcgaagacagcctgtcggatgatttgggagaaagcgaaataacagaagaaccggcagatgagaatacagagatcacagaagaagcagatacagatgaggatgaaactgagatttctgtggaagacttcgcagatgatcaggaagaatggagtacggaagatacagatgaaaatacggcagaggtattttttgaagatcagcaggaagtcggagcaggagaaacaaaggaatatctcaaagatctgagtgtgtattccggttacggagtaaaagatcctcttgaaatgacccgcagggaagatctggatgaaacatatggtggaaagacttatacggttgagattggctccagttacaattccaatggcttttatgtgactgccgatcttggaacggatgcgccgcagggttcaacgattcagttgtctgcatgtgatcttgatggaaaaactgtagaaaatgagattattacaaccggatatacagatggaaaacgctacaatttctcaaatatctttaccaaagacaatggaaaaagagctgtttatacagtaacagccggtacagcggcagacagccagacttataagatcgtagttctcagaagactggatctttccatgatcggatgttatcttccttcggataaggatatggcaaaaaatctgatctcagaatttgacagtgccggtattacaagggattatgaggtagcagtgggacaggatacaaaatccgtaaaagttactgcaagtgcttttaatgataaatggtatggacttacggtaaacggacaggccgtatctgacagtaaggcactggaaattccgcttacaggttcagatacagagattctctttcagatgaaagaagatgggacttatcaggatccggcatatcagacattgtcctatacttccacgggtacttataaagttacggtccataagaaatcgaaagtgacagttacatttaaaacagaaccgtcggatgcagtggtcagtgtatatgactccaaaggggagcgtgtggagccgtctaaggatgcagacacctatgattctctttattatggagataagtatacctggaatgtatcaaaatatggatatatttccaaaagacaggaatttacggtaggtgaggaatctgagatcaaggtaacgcttgaacagcagacagccagacaggaagaaattacagacaatgactggagcagctatcagaacagtgagaccaataatggaatcacagacagagctatgccgaccagcaagaatacgattacacagaaatgggcaacgagattggatgcaaaaggctgggatgcagcacttacaccaccgttgatccttggtggctatgtttatgtagcatccggacagtttatttacaaaatggacaagaatacaggagacattgtccagacaagtgaacggatgtccggaaatatgcagtatgccatgatcccgcttgcctatgcagagggaatgctttttgcacagatcggtggtggtcagatacaggcactcagtgctacgacactgaaatctctctggatcagtgagaaattaggtggacagacgctttcaccgattacctataaaaacggatatatttatacgggaacatggaattccgatacaactcctggctcttatttctgcctttctgttacagatgaagatccatccaaagggaatgagataaaatactgtacatggaaatatgatcacaaaggtggcttctattgggccggcgcctatgcatcagaaaattatctggtatttggatcggatgatggagcgggcgatgcatacacatctattttgtattctgtcaatacacatacgggacaattgatagacaagcgcacagatctgattggtgatatccgttcaacgattacttataacaacggatatgtctattttacgaccaagggcggttatctgtatcgggttgcgatgaatgcagacggaacatttggtgcagtggcaggttataatctgggaggtgcggcaacatcaacaccggttgtctataagaacagaatctatgttggtgtctgtggaaccggaggccagtataacgcagatggaggacatcattttgatgtgctcaaggaatctgcttccggactttctcttgcctataaagtatcgattccgggatacccgcaggcggctccgattctctcaacagcttatgaaaatcaggactttgacggtgatggcaaagcagatggacgggtttatctgtattttacatacaatgcatatccaggcggaatctacatgctgacggatacaccaggacagacatcaggaaaagccgaagaactgtttcgtccggtaagtaagcagcaggagtactgcatcagccctctttgtgtggacaaagacggaacaatttattataagaatgattcctgctatctgatggcactggaaacaaatggcgcttatctggacagtgtgacagcaaggccggatacaggcagtgtaaactgggacaagagatttcaggcttccgagacggaatatacactcagagttgcagagaatgcaaagaatgtaacacttagctttaaggctcctgcaggatgcacgatgaaaataggaaatgatacaattgatggaacatatgtggctgatgtaagttccggaaaagctgaaattaaaattgcggtagttcagggtaccaagagcagagaatatacattccacctgacgaaagatcatggaaattcatccctgaccagtatgatcgtcagcaccagcaatacttatggagaggtatctcattatctgtcaatgactccggcgtttaacagtgcaaagaccggctatactgtggaatatctggacagtaaggcagagaatacacagagatttcttcgcgtttatgtagaaaaagctgagtcagatgcaacagtgaaggcggaaatagtaaagggagtcaggaaagtaactactactaccagtggaaatgcaacacgttttaatgtttactgggaagataatgtggatgaggctcaggtaaaaattacagtgactgctaaagcgggaagtaagacggaatatctgctgactatacagagaaaagaaaaggtttccacaccgacaccgacgcctacagaagttccggaagtgttcggaccgtggcagacgatatcaacagcgactgtttttgcacccgagcagcagagaaggaccagtaataaagggcgtcaggaaacccgtacagttggaagtaagctaacaccgactattaaactgaatgccagaagcatcaggttaaagaaaaaacagtctacgactaaagtacaggtaagtggtctggcagcaggagacagggtacagtcctggacgacatccaataaaaaggttgcaaccgtaacatcccgtggaaaaatcacagcgaagaaaactggcaaagcaaggatcataattacccttgtcagtggaaagaaggcagttgtaaatgtaacagtacagaagacagctgttaaaaccacaaaaatcagcggtctcaagaagagcgtagtacttaagagaagacagaaactgaaactgaagccagtgatcagcccgcttacttccgtggagaaagtgacttacaaaacttccaataagaaggtggcgacagtaagcagccggggtgtgatcacggcaaagaaaaaaggaaccgcaaagatcactgtgaagtcaggaaagaaaacctacacagttactgtgaaagtaaaataaaaaaatggagaatcgctaaatatccacagaatatttggcgattctgtttgacgcgagaatgcataaatgctataatataaggacaacaaaataaccaggcgtggtctggtcgggagatgaccagtttaaggaaatccggtgtgattccggaactgcttttttgctgtatgaaatgttatatgcggatgatattttaagtcagctaactaacgcgttgtataggacagagactcatctatattatgaggctctgttttttgttgttaaaaacaactagcaaaaaaggaggagcaaagtgaagaaaaaagaagtactgaaacgtttatcagcagtttccatggctgccatgatgaccgtaacgatgattccttccaatgcatatgcggcagatgaacttttctcagatgttgaagttgaaacttccacagatgcagaggatgaagattctacagaggtagcggccagtgatgcagatgatacttcagatgcggatgttgaagtggaagcagaagatgacaatgcggatgtcaatgtagaagaggatgaggaagacaattcagaaggtgtggatgcattttctgatggtggagacagtgcagaagagacagatgcatttgatgcaggagagggtactccggcagcagatgcagttgtacatatgactgtcagcgtggctggagaatttgcaaaagacaaaaacggcgcattaatggtagacagagatgtcacagtcaaggatattgataagaatggtatcctgacatgtgacgaagcactcattgcagcacatgatgagtactataatgacggtgcaattgcaggttatgcaaccgcagatggaaagtatggcaaatacatttccaaattctggggagatgaaagtggtgcatttggttactggctgaatgacaattcctgtatgggactttctgatgaagtaaaggctgatgattatttctctgcatttgtctataaagacaaaaaagatttctcagacgcatatgtaaaatttgatcagaaatcttttgcagtagaagcaactcttccatttaccgcaggactgcagaaagcggaatggaataacgatgccaataagtatgtatataaggatttcgatggagcgaaactgacagtttatgattcatcttttaaagttctgccggaggacgcatatacagtagatggggattcctttacatttgctgaaggcggaacttattatctggttgcatccggaacagacagcgttaatgttgttccgacagcagctaaggtagaagttgcgggcgaggtgatcatcccggcgaccagcattaaggtgaataaggagactcttacagtgcaggcaggtggcagtgcggtgttgtccgcaactgtagaaccgaaggatacaacacaggagactgtatggacatcttctgatgaatccgttgcgacggtattaagaggacgtgtaacaggtgtaaaagcaggaaaggctacgatcacggctactgcaggagaccagagcgcaagctgtgaagttacagtaacagctcctcccaaattgtcttctatcaagctttacagaagtcagcaggattacaaagatggtaaagatccgttggagatgactccggaattcagcagagatcagcatacatatgatctgaaagagccgattgcagattatgatgacttgtatgctgtgacagctctggcaccggaatttagggatgctgaaaagataattaaatacactgcgagtgcatgggcgaatacctggagatatgtgtctactgtagatggtgtagctgaaagtgtagttacctatccgacaggatatgctgctttttatgttggaaccagaacagatgatacggaatacagggttaatgttaagtcatatgcaacactgagcagtctgagtgtcgatggccgtatggatcaggcatttgataaagatgttaccagctatcatgcatatgttgacaaaaacgcagaaggcgtgactgtcaaagcacagggtaaagataccaagtatacactgaaagtaaatggtgaagtagtttctgccaacacaaattatacggttccatacaactgggataagaacggtaagatgaagatcgaagttgtggttggcggaaatggtaaagaagatcatacctatacgattgaagcagaaccgtatccggagaaggatgtgccggaatttgtcagccagccaaagagtgcagattatgttgttggcgataagccaaataaattatcatttgtcgcaacatgtacgggtaaactggcttaccagtggtacagcaatactgaagacaacaatacaaccggtactgcaatcgagggtgcaactgaggctacttatcagccatctgctgaaaaagaaggaaccacgtattattactgtgtgctcacaaatacagagcagacagaaaataatacagctacaactgacaccgcttgcatcactgttgatccgaatcctatgccggaagcagtatttgcaaaccctggtgaagaattaggtgaagaatatccatggaactttggatatacttattggaaagactggactgctgacgaactgagtgtaaatgtaacgacaccggtagagggcggaacactttcctatcagtgggttcgcaatgatgcaatagatgatatgtatggcattgttccatcctcagaagctacctgtactccgactacagataaaccaaatgagacaggatatttctatcactgcaaggttacttatacttataaaggaaagaaatattccacatacgcaaaaaccggaaagaaatatacagatgcaagcggtgaagagaaagatgctgccggcgtttttgtatatgtaaaacttgattcaatggccacaccgaatatctccacccagccaaaagatgctgtttatacacagggtgatattccgaacagcatatatatttctgtaagaatttcagaaacttatgcacaagagacttgccagtggtatgtgaatgataaagaaagctatgaaggtgcaactgctgtcaaagataatgaatcagcccactccgagtggtttaatacggatacgaatgagcctggcacaagatattatttctgcgttgtaacagcttcgcttcagggtaaatctgcatctgcaatttccagaatctgtaagtttgttgttaatcctgtagatgactatatcggaactttactgaaaggtaaaggaacacaggaagatccttatctgatctcaacagcagaggattatcaggcagtatcagatctggttgcaaaaggaatttcctttaatgaaagatatctgaaacagactaacaacattacccttccgagaggatggaaaccgatcggtacttcaaagaagaagttatttgccggatatctggatggtaacggaaagactgtatccattccaagtggcgagcttccgcttctgggatatataaagggtgcagaagtacataaccttaagatttatggtaagaagatcgcaggctatggtctggtaaacaatttcgaaggcgttggatttaatggcagtgcgatcattattgacaatgtaacattaaagagcggttccagtaccctgaaatcaggtctgatcggagccaatattacagaaaacagttttgcaggaacctccgcaggtttcgttgcaacaatcagaaactgtaccatcgagagtggtgtagtagtaggttatgacaaagaccagacaatcatcggaggaattgcaggacgtatgcagggtgtgattgaaaactgcgtaagccatgcaaccgtatatggtaaatcttatgtcggcggtatcgtaggcagccgtgataacgctatgggtgacagtaatgtttacagctgtacttttgatggaacagttgtagcaagcggtgaccatgcaggcggtatcgtaggtggcggatacaacgacagctctgcaccgaacggtggaaaattctgcatcaatggctgtaaatcttccggtacgatcacaggatctgacaaagtcggcggtatccttggtgctgatacttatgtattacagacatgggaaaacgttaagaatacagtaaaaggtaactcctttactggtaaagttcaggcaacagctgatggcgctaaatatatcggcggtatcatcggatattatggaagccttgacaaatgggatgatgttgcaaataactactatgcaaaagactgtggcgcagaaaaaggtatcggatttgtagcaaatgtagataccagctgcacaacacatgagacagagagcggtgctgcttatgttactacaggaacatacagccgtacagatgacccgcttggagcagatgctgcaaaacttgcaaacacagaaggtgtacaggtttatattgaagaccttaagctttccggtgaatgcagagatacgttctatcttggcgaagaactgaaccttgacggtctcagtattaaagcagtatacagcgatggaacaagcaaagatcttaactggaaagatctggagatcgaaggttttgacaatacagtcaaaggcgagcagactctgaccctgaattatgatggagcaacagcttccaagactattaaagttctggcagctccggacagtgacccgattcatgtatctttcacactccttggtgataccaaacatggagctgatacagaggaatgccatacactggatggcgagaacctgactacatgggtagagacaggcatgatcgaagtaggtgctaatgaaaccgtatacgaagttatcaagagtcttgaagaaaaatatggattcaagatttatgacagagaaacacagtatggaacttatatttatgcggttgagtacaaagatgtaactctttctgaatttgataacggacagaattccggatggatggatactataaatgatgtgcatccgggtgttggtgttgcaaaacagtatctgaatgacggtgatgtgatcgtattacattatacagatgactataccaaggaagatcagataccggtagctgttaaatctacaaaacgcgcacttacaaatctgcctgagacagcagatcttacactggataacaaagcagccgtagaagcagcacgtaaagcatatgacgccctgacagatgagcagaaagaaatgattccggaagaacttgtgaagaaactggaagcagcagaagctcgtatgaaagagctgcatgtacacagctgggatgaaggtaaagtcacaaaagaagcaacttgcaaagaagaaggtatgaaactttatacctgcacagaatgtggcgagactaagacagaggtaattccgaaaactgaccacaagtacacatggaaagtagtttcaaaagcaactgtctttgcacctgagaaacagcagggaacatgctctgtttgtggcgcagttgtaaacagagataatggaaagaaacttactgcaacgatcaaactgaatgcaacttctatcaagcttcagaaaaaacagacaaccaagaagatcagagtggctatggcaaatggagactctgtcagatcctggagatccagcaataagaagattgcaactgttaatagtaagggcgtgatcaaagcaggtaagaagaccggaacagctaagatcacagtaacgcttatgagcggtaagaaagcaaccctgaaagtaaaagttcagacatcaagagtaagaactactaagatcagtggtctgaagaagaatgtaagactgaagaaaggtcagaaactgacactcagaccggtaatcagcccgcttacttctcaggaaaaagttacttacacttcttccaataagaaggtagcaacagtaagcaaaaaaggtgtcattacagcaaagaaaaaaggtactgtcaagattacagtgaaatcaggaaagaaatcctatgtgatcaaagtaaaagtaaaataaaatctgcaatatgatttttcaggccggagtcctcgtgattccggtctgcttttgcattaataaaaaaattaaaatttcataaagctacttgaagaagcttagaacaaatgatactataaataaaagcatatttctcaaagttctgggcatttttgccgtctgattttcttaattcatttcagaaatccatgcttttaaatccaattaaaataaaaagcaggggttcgaggtgatgacaataacagtacggtgtattcttaaactcctgccagacaggaggtatgcctatggcgagaagaaaacacaatgctgctgtgaagagaaaactaattgcaaaaggaaataacaatgtaaaaatggatcgtaatgcagatctgaagagctatgcaggcaaagagataagggcaaatcgaaagtacaaggatacagtatttcgtatgctgttttcagacagagaaaatctattgtcgctttacaacgcagtgaatggaagtaactacgaaaattcggatgcactggagattgtgacactggagaatgcagtctatatgggtatgaagaatgatctggcatttatcgtggatatgggattattcctgtacgaacatcagtcaacatacaatccaaatatgccactgcgagatctgttttacatatctggtgaataccagaaacttgtgaatcacaaatccctgtattcctcggcactgcagaagatccctgcgccaaatttcattgtgttttataatggaacagaaagagaagaggactactggatcaattatctgtcggaatcatacgaaaatctgagcggcgagccgaatctggagctgaaagtacttactctgaacatcaacgaaggtcataaccgcgaattgatggagcagtgccagagtttaagagaatatgcacaatatgtagcgaaagtacgggaatacgcaagggaatccgatctggatacagcagtagaacaggcagttgatgactgtatccagaatggggtccttgccgaattcctccgaaaacacaaatccgaggtaatagcgatgagtatattcgagtatgacaaagaagaggaagagcgaaaactgcgagaagcagagtatgaagctggatacaatagtggaaagcaggacggatataatagtggaaagcaggacggatacaatagtggaaaacaggatggatataacagtgggaagcaggatggatataatagcggaaagcaggatggatttacggagggaaaatgtgaaataatccatttaatgtttgatgcaggagaatcattggaaaagatagcccaatatacaggctataaagttgaagagttgaagaatctgttaaaaaaataagagatttaatgttcaggccggagtccccgtgactctggcctgatttggttactacagaaaattaaaaattcataaagttacttgaagaaacttagaacaaatcaatttggttatatttaatatagaagagatgaaatttacatttcatattgatgctcctataataaggcacaaaggaggctttattatgagcacaatatttccaagagaagaaaaagcggaacagatttttgacgagatcctgaagaatccacgtgcctgcgaacgtttaaaagatacattttttgcagcgattccgtcagcagaagagagtgagggtgcaggaacggacattccgggaacggtctttgctgcggctttattcaacgcttatgaaaataaagatctttctgcatttatgatggcagtctgcaataacagtgtatttgatcttctccggaattcttttctgattccaatccgttttaatgacaaaggggtggagaatccaatattccttacagatgaaaacggaaaccttctggatgaatcaaaaaatcatatctatgaaaagaagtataagatgttccataaactctttgaagagcaggatgagattccagactaccgtatgtatatggcagatggatttcgtgaaagtcatggatatactcagaacggagagattgagacaatacggaatgcggaacatacaggaatccttttactctttgaattccctcagtctgtagatctggaaatcaatgaagaaaaaatatatgcaatagtctgggaatatctgatgaaattacaggaggagctgccacgtgcattgatgtattatggtaaacgtgacgagcatggaattgaaaaacacaccagcaaactgggaatcttcctgccattctgtcattttgaaagagaaatggaaaagaatattgaacttgcgaatggtatcggactgggatgcagggaagcgattctgtcagaaatgaaggtgctggaaaaatgattttgaaaaagaataaagcagttgggatgtgtatatgatgcaaccggtgatcagaaaaaatcacatggacattgcctggcacgaatatacggatgaaaatggtgctgatattccggtcacgcaggcgagtctgacagaaaaagcatcaatcatcggacgagtggggattatgtttctgtcctgtggaacaggtgcatggcgagtcagaagttcgatgaataccctggctgagattatgggaattacctgtaccgcagatattggtttgatgtcgattgagtatacctgttttgatggtgaggagggctttacccagtccctttgtctcactaatacaggagtaaacacatcaaaactgaatcgtctggaacattttatccgggaatttgaaattgatggaaaagacatgtcaggagaagaactgcatacgctgctggatgatattgaacgaatccatggactttactccccgattgcacttggattcgctgcggcgcttgcatgctgtggatttacttttttgctcggcggtggctttattgaaatgttctgtgcttttgtaggtgccggatttggcaattttctccgatgcaaactgacaaaacatcattttaccctgtttttatgcattgtatcgtcggtttctctggcctgccttgtttatgcaggatttttgaagattggcgaaatgctgtttggcatttcggtacagcatgaggctggttatatatgtgccatgttgtttatcattccgggatttccgtttattaccagtgggattgaccttgccaagctggatatgagatcgggtacagaacgtttgatgtatgcactgatcgttgttctggtggcaacaatggctgcctggatcatggcattgcttcttcacctgcagccggtagactttattaagatgtcaatgccagtaggaatgtggatagtacttcacctgatagcaagtttctgcggggtatttggcttttctgttatgtttaacagtccggtaaggctggcagcaacggcagcgatgatcggggctgttgcaaatacactcagactggaacttgtggatctgtcagctattccgccggctgcagcagcgttcatcggtgcattaactgcaggaatccttgcatccctgattaaaaacaaagtaggatacccgagaatctccctgacggttccttcaattgtcattatggttccgggtttgtatctgtatagaggattttataatcttgggattatgtcactttctgttgctgcttcctggtttgcggcagcaatcctgatcatagcagcccttcccctgggactgatctttgcaaggatactgactgataaaacattccggtattgtacatgaaataaggacatcctgcacagaatgtcctatagacggactggtcgaaaaaaggtatactgtttctatgaaatccattgggacgaaaggagcagataccaatgtgggaaaaaatcaataactttttaaaagggcagattgtaacatcaatcatatacatagcccttggtgcatgcctggtatttatgccggtcagtactgtgaatgtaatatgtaagtttgtatttggaattttgctgattctggtaggtttgtatcatatcctgatctatgtggcggaaaaactgaattccacgatttttgatctgttttctggtggtgttctgatggtacttggaatcttcctgtttatgaacccgcagattgttgtcaagcttctcccgattttgcttggcacatttattctggtggacagcatctggtcactgaagggaagcctgaaactcaaaaaacgtggtgcagactcctggaagttccttcttctgggaagcattattttcattgcacttggtatttcactggtagtaaacccatttacaatggtgaaatacacggtaatctttgccggatggatattcctctgtaatggtgtgattgatatgatctatctgattcttctgagaaaaggtctgaaagaaatcaaacaggatgtggaagcagtggatgcagatggcgagattatttctggtgaagatagcggtgagacagatgatctggatacagaagcttccgtacagccggaagaaccgattgcaccggaaccggaatatgcaccatggagttcccgtaagaaaacggattctacagctccaaaagagcgtacagaagaaatggaaggcacaatgtcagagagtgatgatgtgacagaggatgtattttcagagcgctttgaagaaaaagaatcagcaggtatggaaaatgccagccaggaaagtttctgtaaagaaaaagcggatagagaagtttccgagatggaagagtcacttgatattgaacaggaaaacgaaaatgagacatcagtagaagcagcgacaggtacaataaccggacaggagaacgatacaccaccagccggcagaggcgcatatgttgtatccgagccaacgatcacagatgatgatctctccgacacaaaagatgagagccttcttggaaggttctcccgcaaacgtaaacataataaaaaagaagactgactttttcttttcggcacaaccttcccattccaattacgaagaaccagacaccctcaccataatcttcttatctgaataacctggtttattttctaagctcccgtcttaaacaaaacttcatatatcatcccgcccaggggtgtgcagaggggactggcaagtcccttctgcggtttccatacattccaaagtataactttcttcattttctaaatgaaataaatttttcatagatcccctttataaatatttttataaaaaaatataaaactcttctgaaaaaaagaacacatttcttgattttttatcatggtataaaaaatcaacaaaaactataataaagacagcttaagaaagaacaaatcttacaagtaaaggagaggacaatcactatgaaaatgaaaaaaattacagcaatgagcatggcagctttaatggcagctacaatgatcccgtcagtaccggttatggcagacggaggcggaaaggtttactacctcaacttcaaaccagagcaggatgaagcctggcagaacctggcaaaagcttacacagaagaaacaggaacagatgttacagtagttacagcagcatccggacagtatgagacaactcttcagtcagaaatggcaaagagcgatgcaccgacactgttccaggtaaatggaccggttggccttaaaaactggaaagattactgctacgatctgaaagatgcagatatcacaaaagaacttacatctgatgcgtatgaactgaaagatggagatgctgtagctggtatcgcatatgtaattgaatcttacggacttatcacaaacaaaacattacttgaaaaagcaggatatactctggatgatatcaagagctttgatgacctcaaaaaagtagcagacgacattcaggcacgtaaagatgaaattggtgtaaaaggtgctttcacctcagcaggtatggacggatcctctgactggagattcaaaacacatcttgcaaaccttccaatctactatgaatacaaagcagatggaatcgatgatacagaagcaatcaaaggaacatatcttgatcagtataagaatgtatttgatctgtacattacagattctacatgcgatggaagcgaactttcagctaaaacagctgatgactccagaaatgaatttgtaaatggagatgcagtattttatcagaatggttcctgggaatatgcagaactcgctaagacatacagcgatgatgaacttgctatgattccgatctacttcggcgttgacgatgagaacgaaggtcttgcaactggtacagaaaactactggtgtgtaaataagaatgcatctgaagaagatgttcaggcaactctggatttcatgaactggtgtgtaacatctgaagcaggaacaaaatctatgtctgaagacatgggattcacaattcctttcaaaacagcagttgctcctacaaacgtatttgtaaaacaggatgctgagtatacagaagctggtcttacacctgtttcatggaacttcacaacaatgccatctgaagagtggaagaatggtcttggtacagctcttacagcatatgcggcaggcacaggcgactgggatgcagtagttagtgcattcgttgacggatgggctacagaaaaagctctttctgaataatcaggatagaaaataacatgttgtttatgggaggaggcagaggttcttgcctccttctataagttaaaagacagaggaacttaagcttctgttaacagtagggaagaggagaaaaatcatggtaggaagaacgatcaaaaagtggtggccggtttttgtattaccaacctttgcggcatttgtaatcggtttcctgtggccttttatctggggcatctatctttcattctgcaaatttacaacagtgcaggatgtaacatttgttggattttcaaattattctaagattttacttgatagtacattcagtcattctttctggctgacagttgtatttgcattcgtatccagtattctgatcaacgtgcttgcattttttatcgcactggcactgaccaaaggatacagaggaacaaatgcattccgtacggtattctttatgccgaacctgatcggtggtattgtacttggttatatctggcagacattgctgaatggtctgctttccaagtggggacagccactgctttcactttcagcaaaaaatggttttatcggtatgctcattctgcttatgtggcagcagattggatatatgatgatcatttacattgcaggtctgaacaatgtatcacctgacctgatcgaggcagctcagatcgatggtgcaacaagcagacagattctgtttaagattaaaattccgatgattatgccatctgtaacaatctgtacattcctgactctgactaatggtttcaagatgttcgaccagaacctctcactgaccggtggtgatcctggaaaacagtctcagttactggcgttaaatatttatgatacattctatgcaagaagcggacctcaatggaagggtattgggcaggcaaaagctgttgtattctttgttctggtagttgtaattgcattgatccagcttcgtgcaacatcatctaaggaggtgcagcagtaatggaaaataaaaaaagaaattccgttgcaacggtcttactgacaattgtttgtatcctttggatgtacccaatcgtcttaatattaatcaactcactgaaaaaagaagtagcgatcactacatctggagtatttagccttccaaccagtgaaacatggaatggtgttgcgaactttgtagcgagtgttactcagatggatttcctgaaatctttctggtacagtcttgtaatttctgtaatgtctgtagttcttatcatgttatgctgttcaatggcagcctggtatattgttcgtgtaaatggaaaactgtccaagatgttttattatctctgcgtgttcagtatggtagttcctttccagatggttatgtttacactggcaaaaactgcagatactttaaaattgaataatccatacaatatctgcattatttatcttggatttggtgcaggactggcggtatttatgtttacaggatttgtaaaaggtattccgcttgagattgaggaagcagctctgattgatggatgtagtccgttacaggtgttttttaaagttttgattccgatattaaaaccaacaattatttcaacagcgatcctggaactgatgtgggtatggaacgattaccttcttccaacactggttcttgatattaaaaaatataagactattccgatggcagtccagtatttccgtggcagcttcggacatgtacagatgggaccaatgatggcaagtattatgatcgatatcattccgatcatcattgtatatctggtttgccagaagtatattattgaaggcgttgttgcaggtgccgtaaaaggctgattctggttatgtagaatggaagtctctggaagaatattttttccagagactttttgtgctataatcataagtattataggaaacaaaacaggggggaattatgacaaacgttcttattgtagatgatgaaaaaatagagcgcgaaggtctgaaatatctgctttcgagagaagaaggcgaaagaaatgtttttgaagcttcgaacggaaaacaggctctgcagattattcggtcagaggacatacaacttgttttgactgatataaaaatgcctcatatggacgggttggaattatcaagacgtgccaaggaagaaaatccggcattgcagatcataattttcagtggatacagtgattttacttttgcgcaggaagcgattcgctatggtgtgacagagtatatcctgaaaccggtgaatccggaagattttcataaagtaattcagaaggcagagaaagtgattgaacaaagaaagaaaaaagaaagtcgtgagatcaaagggaaaaattttctgcaacagtattttctgcaaaattatctttactccggcaagctagaaacactggaaaaagcaaaagatataatcaatctggaaaaatggaatggctggcattgtggaatcttgctggaatccgatgtcgctttttttgatacggctgaagagactctggaagaggaaattcagaaagagttgagaagagtatgcttttatctgaatttgaatgcaagacagtcgcttctcctttttcaggacgtatattgcgattatcagctggtggcaaatcatctttataattttatgaaacgaaaatacagagacagtttttatctggcagtcagccgtaaatttgaaggttgtgagtgtctgccggaaatccttgagcagctggaacagcagatggaagagaaattttatcatccggaaaaacatgttttctcaaatgaagatgatgtactgaaactgtcggtgggagaagtgcaggattcgcagatcatgcagatgatctcagaagacatcacgcggaaggatacagatcagctgagaaagcatttcgcatgcctgaaagaaaaatatcatgataatacacagtattcagcaatgtatatcaagtttgttttctcgaatgtcattcaggaactgtttcaggaaaatcagttttctggagagcggcgtcttgagcatgagatagaacgattgtataactgtagaaatatcatggaaatcgttgaagtgactgaagataatatcaaggaatacgaggcatttcttgaccgttctatgagtagttctagaaatgaagtggcagcagtcaaaaattatatctatcagcattatgaggaagatctgaatcttgaaatgctggcagaaaaagtctatctgtcttccggatacctcagttttatcttcaaaaaagagaccggcatgaatttgaaccgatatatacgtgtgttccggatggagaaggcaaaagaacttctctgcagcaccaatatgaaggtggcacaggtcagtgaacgtgttggttttgcaaatgtttcttatttctgcagaagtttccgggaatattacggaagcagtccggaatcatacaggaaaggaaccggagaggatgaacagacttcgtaagatattcaaaaatatgaagtatcgtcataaactgacgatctttcttgtagttacaagcctggtaccgatgacagtacttgcctggtacagtcacagcaggctgagtactatggtccgcagcagcgaactggaagatatgcagtcgatcatggaacagaccagagaaagcattgacagccagacggcggtttatgccagccttctcaattatctgacctattcaccagatattgaggaaattattaaggaaaaaaatatcgataattatacggcgtatgaaaaatatacagaaatagcggatccacttttgtctgtaccaaaatcatatcatgatgcgatcaacagaattcagctttttgcggacagtatccaggtggagcatgagtatacacttgttccgcttgataagatgaaagaagagtggtggagtgaagggctgaaagatgatgtgcgtattcagtggaaagttgatcaggatcgtaaagaagttgcagcagtacgtatgatctataatgatcagaaactggatgcagttctgtgcatttctctggattataataaaatcttccagccactgaccaatattctcacgcaggaaaatggtggaattgttgcagacaaaaacggtacagttctttataacaaaactggtctgacaaatctggaatttgataaatctggaaaaatggattccatgattcagaaaatcagccagtcctgtgcatatacaaagactaagagtgaagaaaatgactgggtattttatctttataagagtcaggatgcgatatcaggttctgtacgaagactgctgctggaagagattccactgattgcggcctgtggtctgatcattctgtttctggctatggcattttcaagaatttttacaagaaaaattgaagaactgacgaaaaatatggacagggtaaatcatggaagccgtgaagttacagtcaacagtgattcgggagatgaagtaggaattcttgttaacagtttccgtaatatgatggatgagattaaccgcctgatcgacgaagtatatgtcaataagatcgcgttgaaagaatatgaactgaaagcccttcaggcccagatcaatccacatttcttatataacacactgtcgatgatgaactggatggcgattcgaagtaaccagatggagatcagtaaggttaccctggcactttctactttttacagaaccgcattaagcaaaggtgaagatgtggttacggtagaaaactgtattcagaatatggaagcatatctggaaatccagcttacgatgcatgatcataatttttcggtagactgggatattgatccgacaataaaaaatgaaaaaatgccgaagcttcttcttcagccggttgtcgaaaatgcgatcgaacacggtcttgatgaaaaagaggatggtgataaaaaaattttcctgtcatttaaaggcaagggggatgatgtagagatcactgtccgtgacaatggacttggtatggagcaggaaaaagcagaaacactggtaacttatcaggcaaaaggatatggccttaagaatgtaaatgaccgtatccggcttctttatggagagaattacggaattcatattttcagttcaccggatgaaggcacgactgttattatgaaatttccgaaggagggcagagagaatgaagagtaaatggaaaaaactgcctgttgttctgataggaatcatagctatagctgtctgcggatgcagcaatgatttacaggagctgaatcagaaaagatcatcggcagcaaaagaaaatacggaatctacagagacagtccgtaccggtacctgggaaacagctgcacagactccttatggcgcttatcctgaacttgtaacgtatactttaggacaaatgagtggtgcgaataattcaaatcttccggatggaaatacctatgacgacaatgcttacactcgttatctcagaaaaatactgaatattcagaataaaagtgtctacatggaacgggaagatcgatatgatgaatttgtgaacattcttgtaagagaccagacgctgccggatgtactggtggtttcggacagagaaacactcaaagaactggttgataatgatcttgtggaagatctgagcgaagtatatgagaattgcacttcagagagaatcaaaaagatgtttgagagttatggaagcggtcttctggattctgtgcgatttaatggaaaactgatggcaattccggagaccgttacagatcatggtccacgtctgatgtggctgcgtaaggactggatggataagcttggccttgaaaatccgaaaacactggaagatgcatttgacatagtagaaaaatttgtccagaataaaatgggcacggaggatggagaagacccgatcggactcgcttgtgatacagatctggtgggaactaccagctctaattattcagtagattctgtttttgataaatttggagccagtccacaaaggtgggtaaatcaaaatggtaagatcgtgtatggttccgtaacagaagaaacaaaaaatgcactgagttatcttcatgaactctatgaacgtggcgtgttggataagaactttgcattgcgtgcgcagaataacctcagagatctggtgataaatggaaaatgtggagctttttttggcctgtggtggacaccgaacaatccactgatggatgtttatgagacagacaaagaggcaaactggcagccattttatctacagtcgacagactggcagaatgtatatgatacttttcaggataataaatatgttgttgtacgcaaaggatatgagcatccggaaattgtaatgaagataatcagtgtattgtttgattatagcagatatgaagccaaggatgcggatgaggtaaatgattattttgctcttaacgtagaaccgacagccagaccgctggttatcaatgttgattataacgaggcgacgtttcagatcacaaaagatatccagagtgtaatgagcggcatgcgaaaagaagaaagtttaagtgcaattgagaaatcttattacgatgcagcagaaaaatttattcagggaaaatcagaaacggcggaagactgggcagcatatgaatccagacttgcagcagttggaaggttgatagaaggaaactaccggtcaacagccaaaagatacctggatgatgcagacggtgaaataccgaagtctcttcagcagcttgaaaaagacactttcattcagattatcatgggtgtaaaaccaattacttactttgacacttttgtgcaggaatggtatgaacagggcggcgaagagctgactgagcagattcgccgctctaatccaggagaatgattattttccgagatgccagatgtcgtcatcgtactctttgatggttctgtctgaggagaagaatccggcttctgcaatattgatcagagttctgcggctccatgcttccggatttacagcataatcactcattgcctgttctttgcggacaatgtatgcattgaaatccggaagagtctggaaccagtctttatttatcagttcgttctgcagtcgtttcagatgttcttcatctccatatttcagcatttcttcactggtaaggaaatcgatggcacgatgaaggttcgagtctgcttcataccagtcttttgcacagtagtcaccggctgcatagcggtgaataacctgcttgctgctctgaccaaagatgtaaatattgttatttccgacagcttcggcaatttctacatttgcaccatccatggttccaagagtcagtgcaccgttcagcatgaatttcatgtttccggttccggatgcttctttggaagcaaggctgatctgttcagaaagatcacatgccggaatcattttttctgctgcagaaacattgtagttttctacaaatgcaagttgcagatatctggaaacttcagagtccgcactgataacctgtgacagggtaagaagagcgtgaatgatatctttggcgatgatataggcaggagctgcttttgcaccgaagatacttactaatggagttactggagtatgtcctgctttgatctccaggtattcatgaatcaggaaaagcaggttcagctgctgacgtttgtattcatgaagtcgtttggactgaatggaaaacattgcattggtgttcaatttgattccctgtttgtcttctaaccaggaagcaagtgcttctttgttggattttttaatacaactgagttttttcagtacttctgcatcgtctgtataattcagaagctttttcagttcagaagcatcttttttgaaaccggatccgatcagagattcaatttcagaagtcagggccggattacatttcagaagccagcggcggaaggtgatgccgtttgttttattattaaatttgttcggatacatctgataaaatcctgccagttcgctttctttcagaatctgtgtatgcagtgcggcaacaccgtttgtggagtgagaaaaatgaatatccatatgtgccatatgaacgacctgattctgatcaatgatagcaagtgaagaatcagttgtacgtgtttttgcaatgtcatccagcttttcaataattggcataagctgaggaacaacggtatcgagataatgacgtggccatttttccagagcttctgcaagaatcgtatgattggtatatgcacaagtatctgttacgatctgaactgcctcatcaaagctgattccgtgttcctcaaggaggcggatcagctccgggattaccatacttgggtgtgtatcattgatttggatagctgcatagtcggcaaggtcatgatagttgcatccacgtgcagcacattcgttgagaataagctgagcaccggcagaaaccatgaaatactgctgatagatacgaagcagtcggccgtcttcatcggagtcgtctggatagaggaataatgtaaggtttctggcaatatcttttttgtcaaaagaaattccgtcaccgatcacagattcatctacagaatccagatcaaacagattcagcatattggttctgccttcatagccggtaaccggaagtttgtagagtcttgcagaataggtgtttcctgcaagcgaaaccggaaatactgtatcggtagctttggcagcacactggtcagtcagccagaaatcaggagcttcgttctggatgttgtttttgaaattctgatgaaaaagtccgcagtgataacgaagaccgacaccatcaccaggaagatccaaagttgcaagactgtcaaggaagcatgcggcaagtcgtccaagaccaccatttccaagacttggttccggttcctgctcttcgatatctgcaagagattttccgacactggcaagtgtttcacgaacttcatcatacagaccaaggttgatcaggttgttggaaagcaattttccaatcaggaattcagcagaaatataatacagttttctgccagttactggttttatctgtttctgactctgttcctgcacaagtttcagaagggctgtataaagttctgcgtcggaagcagttgcaatatccttttggcaaagttcatttagtgttgttttcatagattcactcatgggagttgctcctttcatatataaaatggttgtagtttcgttaacttaagttgctttagttatatcacagatagtccgtcgtttcttgtcaaaagcgagcaagaaatgatactatcctatcatagaggcggaaatagatgaaagaaaaagaaagtggtacaaaatatcaggaaacaaaacagcatggcagccggttgtttccgtttaatatttatccatgtacgattccattggattttccggcggttcctttgcactggcataaggagatggaattgatttatataaaaaagggaaaagggctgatccagatcgaaacaaaaagctttgagggagaaccgggggatatttttgtagtaacacctggaacccttcatgcaattcataggataaaaggatattctatggaatacgaaaatattatctttgaaatggattttctgggagaaggagcagcagatctctgtgcaggagaatttctcgtcccgcttgcagcaggtaagttgtttcctccggtacagataaagccagaggaagcgcattatgattcattaaaaagatgtcttattcagatggaagaattgtgtgaaacaaaagaaaatgcttatgagctaggagtgaaagctgcagttttgcagatcatatttcttcttataagaatgtatccgtccagagaaatcgtgtcttctccggatagggagcagttgaaagaagtactgcaggaaatcagtgttaaaagcagtgagaatctttcagtagcagacatggcgaaattttgtggctggagcagcagccacttcatgcgttggttcaaaaagatgacgggagacagctttacttcttatgtaaatgaccggagacttgcggaggccgcagaggcattgcgccagactgatgataaaatattgacaatctcacaggatgcaggatttatgaatctgtcaaattttaatcgtcaatttaaaaaacgctatggagttacgccgagagagtatcgggaaatgataggaatttaaagattgtgttaaaggaggtacatatgaagaaaaagcgcggaccagagcaaaagtatttattgcaattttgggactgaatgtgacagttgctgtattgggaggctgcaggacgcagagtgtacgaaattgaaaaaataaaaaaagttcaaaaaagtgttgacagattctttttatagtggtattctaactaagctgtcacaaggaattgtttcttctgaataaacaatttgaaaagttttgaaaaaaacaaaaataattgttgacaaagaaacgaacatgtgatagagtaaacaagtcgcttgagagcgacacacagacatcaaaaaatgcctcgaaaaaacttgaaaaaagtacttgacaggcgctgatgaatgtgataaagtaaacgagctgtctgagagacagacaaacaaagaaccttgataactaaacagtgaaacacatacgattctcgaaaattctttaagaatcatcattcaacagaatgaactttttataaacagtaaaacgagagatagctagttgttatcttgagtgaatcaaacacttcacaagcctttggcttgttcagtgatggacaattaagctgatgcaagcatcactgaattgttaacacattttatcagagagtttgatcctggctcaggatgaacgctggcggcgtgcttatctacgctttcatctcggtaattgaattgccgaggattcccgcttatcgtcctaaataatattttaatacaggattccaaaataatccagatatctctcagtcattcatgtattcatagtagtccgattcatctgcaaataatctgtacacaccatctaccagccccatgtaaccatctgtaacgaaatatcctttcatgaaattcaccgcagcctttctgaaatcttttactgttgcttcatttgatatacctattatctcagaatggcaatgcaaaaatctgtacttccaaaacttttttattattttttatatatcttctcttcgatacttcaaaatatattcccatttcggaatttattttaggatttcagtacttatattcccattttggaatttattccagaacatagtttccgttgcaaatcataacactttcgtatatgaattgtttaccgtatacgagaattaacatttatcgtgtacaaatttataacaaaagaaaagagccgttttctcgactctctaaccttaagacactttagtacatttttgtctcatactattttatttatcattttctaaaagtgctttccaattctctttaaatcccattgttgttatatcaacattctcatatttatcgaacaatatctctatcttatctacaaacatattccaatgattatcatttttcaaaatatgtttaagacataacaacactccaaaaatacgattatttccaataccagcttctgaatattccttgtacaacattggtgtttttgataattttgcattatacaagcgaccataatgtgcacatatatttcgaacataagaaatgctctctaacccactctctaagtacgtatatcctatcccaaacgatttcgctattgcttttttatctgggtttttcatatttttgtaaaacttagataatgtaccaaaactgaaaacttccaccagcgcatatattggcaacatcccacctgcatagttcatccgaaaattcttaacaaacggagccttagaatttcttcttatttcttcatgaacatccttcaagaactcttgatgatattttacattcacaaaattatctgcttctaaataacctaaaacaccatatttttcagcgaaataattcgaaattctacatcgcacatttatttctattttttcgatttcagggaatataatttgacgaaaatttgcattaaaaagatataaatctaccagttgttgaaacgtaatgttttctctatatcttccttcatttgtcttaagatttaaactataggctttaatcaatctaaagtatgaaatgtcatttaatattcttttcgcatactcctcatcttcgacaatcaacccaatattttttaaattctctatctgttcatcaattgtcataggaggctgatgttgttttacttctcccatccaacattctccttaaattaaaagacccaacgtggtccgcatcgttgagaggcgtgttgggttctgttaattattattatattcattttaaggaaaaaatcaaccgttaagtatacttttttaatttatgataaaatatctcccaatgcatcttctgcactgtcaacactatgatatcctgtttctttcgtgttgccattactgtacttcatagtaatgccaccttttgtatctcctggcttatagtaataatatcccgaatacacattacccggctcatcttcactaaaatcccaatgcgtaccataattataataaagcgcatccataaaagcctcattattaaagtattctgcatataatatcgtaccatcatttttatcaaaagatacctccagagtatctcctggatttgcatacctctgaagcgctgcaccttcttcgaacgcgatattatagcatcttttcttcggtgttccattataatcttctgccgtatatgcaacctcatactcttcgagcaattttagaagatcatcctctgttgtatctttatcgattgccagaaacatcttttgtatatcatcgtattccttagttgactctactggtgattcagttggaacagctgacgctgccacgctaaaagatgctgtagatacgacaacaccgactacaactcctgccaagctaatttttattatattctttttcatagctataccttcttatctttttacttttcccaataaatctgtgctttcctgtacgagtctagtcaagcactcttagtatttctatatatccccactagattacccaaataaccgccttcttcggtcctaatcatcacatctactacccgtacccttctaattaatagtccttatatccaacttacctaaacgtcatgcataaatagcaataggaattacaataactgcaggactctcgattttagtccgtaattcaggtaaattgaactgcttcatatcatccgtttttaactcagcaaacaattcatttagcaaatcttcttgaaaaatcgataacgaagtttttctaagtaaatcaatattttcagtatcctctttacatatcgatattacttttccaaggatcttaaaatgtcctccaagtatttcagatatattatcattggcaagatattgttcttgtactgataatactgttgttcccttcacatctgatagaataaaatctattgttccactgtgttttaattcatcagtaaacgacttaatttgctttactacctcatcttctttttgtttctgatttttcgcttgtgttctgttacccaattgtgttttttcggtaaaaatatctgccatgcgaaacaaatcaataaaactgtccatataatttattatcggatttttttgcagttcaccctcgacttcaataaaatctcccactcgtacttctgaaaaattcaaatcagattttaatattttattttctactaaaaagcctctaaattttgataaaagcgaaacatttgtatgcactttttctttaataacattttcattttcccctttatttccttcatggcttaatccaccagaaacatctatctttaaaaatttactcaaaataggcgctgaagttgatattcctgcatcaactttctgtgcagaactactttctttatgctctgtataattaatttgacttaccatcgaaaaaccatcttctataatagcaagcatatccaaaacaattttctcgtttatatacactggaataattaatctatccagttttatattattttccatatttgcactccttccattcaattttatacttttagtgtcaaaaatttgaaattaatagtattctctaacggtatcaaaacaatgtcgtatccgctacaaagatcttagttttccaatatatacgtccctataattcatgctcaggacaaatatattatttaacctgtttgtctatcaacatctgtcgcacaatttccatcatacaagcatctgttgccattcgttgataatctggagctacctttctagcagcttcgcaataatcggaaatagctttaaccatatcacaaatatttttttgttgttctacatttctccaattttctaattgctgtacataagtgttttttagatacattggattaaaaatatcatatggataattttcataattcatcagttgtacctcctaccttaaagaaagtaatattgtatcttatagttccgattcttttacgtaagaatctttatctttaatactcccaaatctcatatccctgccgtcttgctgactcatacaccggcaacatattcttctccagaatattataaaattcttcctctgtattccccttccggtacagttcctgcccagcccagatagaatgcagattatctccataacagacttcaaatcttttatgtatatttgcattttcatgaatcatcccatacaagatatactgattataagcaaaatctttaaagaaaggattccatttcggaaggcgattactctttgaagaattcaaagaagattccatcggcatgagattccatagctcatcgttcattacaaatgaccatggaataaaatgatccacatcgtactgctttggaacaatttcacgtccagtaaacacatctcgaatctctcgtacttccagaacaccctcccacaattttcgaacattggatagcttacgcattttgtcattcataggaaccagtttataaataagtcctggaacttccggattattattttgcagccatttgactttttcatattgaatccatccaagaatatttaccgtattatcctgaatcattttaatccaatcctgatgaaaacgaacctctttctttaacttgctactctcacctaaaacgtatggaagtggtgttatattatcattaatttctttaatatacgtcgtcatacggcgaatgctattccactcagccttttctttactgcgtgcaaaaaatcctgccagagctctgtacggaaccatatttgtaagctgttctttaaaccttttcagctctgaattatattcacctatagcatttttaatttctattttcgaagcattcgccggaagtgtactgagttctgtcaattgcagaattgctcattccaacccatcacgtaccattccatctgcctgtaatccactaagatggatgtgaaattctcgcacagaataccaagcatttgcaatcatttcgtcgataatcgcatcaaatgttgtttctgtaataccttcagaaatcagatttacgattgcttccaaccaataaaatttataacaaaaggacggatctttcaacatctgtgaaaagccctgtatatcaagttcgttgtaatattgaactttaatatttaacacattttcctgcgtaggataatattgagccatctttcgtcccctcttccatctctaacatcaattgttgatctaactgccttaccagtagaccttctaaaaatcatatctgatctcctatatcaattttatttattaaaataattatatcatttaactatcagcatcacaattacagtttttgcgctattctttctgtttaacgaatgaaaaaagacaccgaccgcagtcaatgccctttcccctctcactttatgctcttttcgttgcttccttgtaacctttttctatacttttacacgctcaggatatgtacgaagactaactcatctccttcataaaattacttttcaacctctcaaaatctgcgtaccatctttcccctaaattggcatttaacaaaagaatcatttcttccatatcaaaaatctgtattctcgtatccatttcttttaatgcttttgtagcgtaacccgatgtaaaaataactgctcgggttgcttcttcacttagcatggtatatcctaacgcacgcactgtttctttctttaactcacaagttttgtacaacttgcattctacaaaaactttctcttttctttcattctcattaatttctgcaatgatatcttttccaccgtctctcgttgccttcgtcaaattcactttatatcctaacgcttcatataatatggcaattaaaatttcaaactctctcgaagttaatgaaaaaatatatgcatttttatcagaagcactctttatatatttttcctcgataatatccatcgcatccgaaatgccatatattcgatcatctggcatatatatacactcggcatcaaaatacatacctaaagcttttaacgctttcattggattaatatttaataacggaagcacccaggttaatccttcccaagcttcttgtttattttttatacgataaatccgttcattatatttcaattgattcatacataactcatatgtttgtaaatttttttctttatttacttggtcctgtacatattctttgtagaattcatatgtgtcaactgtatctactcctaaagtatatggctgaagcagtattctcaataactctttgatttccatatcacttttctgctcaatatctttcatccactctctaaagggaacaaaaaactgtggataaacaaactcttcattacgctttctcaattcaatccactcttcaagtgaattgtaattgtcggtatatatttcaggtctttccatttttcacctcacacctgactttgtcatttttcttagtcgcagttttgctccccatagtcgcaacctcaccgcctttagtcgcaacttgactttcattatcctaccccaaaatcgtatgagtgctactcatccagtagcccctcccaaacccatctccttctgcaaactctggttcttttcctgaatagaatttattgtatttgaacagatttcgcacacctgagccaatctactccacgtatccaatatttctgatagatgcttcataaacatatttcacaatttattatatttctctttcttccctttcgccttgctcacgggatatttctcattattgaccttaatcttctcctgcacaatctcatcgatatccagtccacaggcatctgccatgaggacgcaataattcagcacatctgcgagttcttctttgattttttcctgttttccctcattggaaacatctgtaccgctccactggaatacttcaagaagttctgctgcctccagggaaatggagattgccagatctttaggattatgaaattgcttccagtcacggtcatctcggaatttcaaaatctgttttattgtttcttctgtcatttttcttactcctgttccgctgctttttttaatgcttctcttaactggtcatcgcatgcatatatgtacaagccatttactccacgtgtcataaggacacgaatctcatgcttcagtaattcttttgcaaagttctgctttgtaccatcttccatggttctgttcttggttacttttccattactggtttcacttggatcataaacaattttgccatttcgatattttacagattttccaagaatcactcctgcatagttgagatcaaatccctgaattgtataagttgaaccaacttcggcaattgtgtgtgcctgctctgcccatgcctgttcttttatcttctttttctcatctttattaagattttgttccaattcataattccatggcttatgccatctctgattttcaatccacacatctacttcccagtatttttttgatgtatcctccggctttttgcctttcttataatcccagtcataattggcaataacacgcgacaatcgactcttctcgctgcttgctttcttttttatttccaggtctaacgcttccggcgaatcgaatatttttatttcataatcatgatgtgggattttgtttataatctgtttcttcgtaaaggcatcaatccatgcaagtgtctcattatccgcctgcatgcgtagctgctttgtcagcgtaatataattctgctgctcgattgctttattacggtatctgtcaatcatctgtttttcccagtactggtccattctgagtatctgattctcatcaaatacaatgacaactacttttgctctttttatgatatcatccaactgattttttccgctgtatccctgatttccctgggtaaaaagcaaatgtgcctcatcaataaaaacgacatctacagaatccagatccttatgcctgttcaaaaaagtggaagccttacttactacttcaccatatttttctgtaatccccagcttctttgcaatgtcagaatacacttttacctgttcatcatgattgactaccatgcagcatttgaattctgcattgtctttttcttcttcctgacagtacaattcataaaaaatgttgctgttcagaaccgtttttccagttcctgcttcaccatctataaatatgatctgcttttcatgcttttgtctggcaagatcaatgcattccaaaatctggattttggcattctcctgctcatccgttaatttgtgcaacggagatgctttataaatcgcagaatctttcacgatattttcatccggaaaaagttcttcatctgactcatgtagttctgtccatattttttgaaatatttcttcgaattctgccgatggataataatgcttctgaggatttcctcttccattatgcacctgatgcactttatccacactcataagataatgcataagacgattttcgacatccaatgtcagggacttattgaaatgctcatggccgatgatatataatgaagcatctgttttcatcattctatattgccatgtctcatgcttgattctactttgataatgctgtctcgtacgcgcaaagatattgttggattcaccgacatatacatcatacttattcgtttccggccagttgtggatgtataccgtcggaaagttcatgataatgtctttggtatcctctgcttcatttgttttgatttctttctcaaattcagccagtgcagtttcattgtcttttatctttctaatgattggttttgtgatgttcatgctcattatcgttttttataacccatcttcccttacggttgttaccttctcgtactataataagattctttagatttggtttcaaaagtttctctgggttaattatatcatttaaccactcacacctcaattaccgttttgttgtttatattgtcaaaaaaaggcaccgacctccgtcagtgcctttctcatctttatgctctttccattgcttctttgtaatcttttgtatctgtgaagatctcgttcttccacgggttctttttctgtacttttgcgcgtttcaggatgtatgcgaagacgaatacattcactgcaaatgacagtacggaaatgattccctgtgcggtcggttctgcgatagtcggcatactgcttcccattgctgctgcgatgccgccctgtccgtatacggaagtgactgttgtgaaacggctcgcatcctggaacagcgggaatacctgtgcgaacatgcaccagagagccagtgtgtttgcacggttctgaatccaaccgcctttattccagagtgctgctgcaaaggtaggtgcaagcagaagtgccagtccgcagtaccaggaatgtgtcggcaggttcagatatgtatattggaaattccagatatcatatgcaaggacatatacccagatcatgtccggccaaagcatatcttttttgtcttttgaggaatagattccccaccatcctgtcatacagaaaatatttaaaattccggcaagtccgtttaatacgttccaccaacctccataaagccatacaccttcggaggaaagccaccaaccgccagcaagcgaaccggcacggactgctgattcaaagtctgatgctactgcgatcaggatattgattgcaacaatgataaacggaaaagctttaaatccatgagattttccaagctttccccagtggtacttcagtatcataaatccgatacatcctgctgttgctgcatacagctttgcataatggaaccagctgttcatgtgcacatatgtatcattattcagtgcccagtcggctcccattgctgcgccaacatagatagcgataaagtacacgctaagtgctgctggaaggatcaggaaacaggcaataccgcccgctttggatcttcttgcgatttcattcattacgacaagtccggcaaataccagcagccatccaagaagctgccatccggctgtctctccgtagatttgaaaaaacatactctttactctccctcttttgtttattctacttctatttccttaatgttgaactcatttccctgcaataaataggtatgctcacttccgcaatgtggacaggtttttccatgttttaccgttggatatgtctgcttgcagtcttcacaatacgtgagtgcaggtaatgtttccaccactaattcagattcatcgaacagaggccgcttttttgcagcccatgtccagcaattctgtaaataggactcgatcactgtcgagacctctcccagttcaagtgtgacttttcgtacatgtgtcactttattttcagcggccaccttttccagatgatccatgatatgaaaagttactccaagctcgtgcatatttttgctcctttatctgagagctgctgcacagctcctattttttctttttgaatttcactttgattgactgtttcaccatgtttggaagaatgtatttcagcttatcttccgaagcacgcataatggaagctcctggaatctctctgtgcaggtggattgcatcaaacatacatttcgttgtacagacaccacatccgatgcatttattcgggtcgacaacagatgctccgcaggacagacagcgggaggtttcttttttcacctgttcttctgtcaggctctgtgacagatcacggaaggtttttgcctgttcttttatatctgcttttggcggaatctgacgactggatgagtcgtaagtttccactttaatgttttctttgtccagttcgatgaaatcacggcggttacgtccaatcgtcagtgtacaatgttcatgcacatatcgatgcagggaaaccgccccttcgcgtccggccgcaatcgcatcaatggcaaattttggacctgtataaacgtcaccacctacgaagatatccggttcggaagtctggtaagtcagtttattagcaagtgcgccaccgttcgggcggagttctacatgaagattatccagcatatggccccagtcgattgcctggcctactgagaaaatgacatggcggcacggcacagttactgtatcgttctcatcatattccggtgaaaatctgccctgtgcatcaaatacgcgggtacattttttgaaaacaacaccgcttacatgaccgtcttcttccagaacttcttttggtccccagccacaattcagctcgattccttcttcgagtgcttcttcgatttcctcgttgcttgccggcattttttctcttgcttccagacagaacatggaaatcttcgcatcggtacatctgctgctgattcttgctgcgtcaattgccacgtttccaccgcctactacaaccacatcaccttccagtgcaaagctctcttttgcaccggcttttcttaagaaatctaccgcagtatatgcaccttcagcattttctccactgattcccgattttcttcccctctgacatccaattgcagcataaaatcccttatatccctgctctctcaggtcttcgatcgtaacgtcttttccaatttccacaccacagcggatctccacgcccagctggcggatcacatcaatttctgcagccaggagatttttttccagtttgtaagacgggattccataacgcagcataccgcccggttctgcatttttttcaaaaatcgtcggtttgtatccggtcagtgcaaggaaatatgcacaggataatcctgccgggccggctccgatgatcgctattttttcttcaaatccacctttcaaggatggaattgttttctttggaatgaaacgtgtttctgcattcaaatcacgttctgcaataaaacgttttacttcatcgattgcaacagcttcgtcgattgtgcctcttgtgcaggcatcttcgcagcgacggttacatacatgcccacagactgccggaagtggattatctttcttgatcagtgcaagtgcatcctcatagcggccttcttttgcaagctgcagatatccctgtattccgatatgagccggacaggctgttttacacggtgctgtaccggtatcatagcagttgatacgattgacatcacggtaattatgtgtccacatatgttcgccccatggctggtcaccaggaagcggcatccgcggatatgtaatctcgcatccttctttatcgcagagtttctgtcccagtttcaccgctcctgccggacaggcttccacacattttccacatgcaacgcagttctgtttctcaacttttgcgatgtatgcagaacgcgacatatttggtgtattaaaaagctgtgatgtacgaagtgcatagcagacatttacattgcagttacagatagcaaaaatcttgttttttccgtcaatgtttgtaatctgatgtacaaaaccattttcttctgcctgtctgaaaatatccagtgcctcttctttggaaatatatcgtccgtctttctgtgtctctacaacataatctgccatatcaccaactgcaacgcaccatccttccggatcatcggcgcagccttcgtcatgtgtcagtcgggaacgacggcaggaacaagggcttgctgcatattttccctcatatttactaagccagtaggaaatatgttccagatcaacagattcattttccatctcgattgctttttcaacagggatgacatgcatgccgattccggcaccgccctccggtacaaatggagtaattttctccagtggcaaacgggacatatgttcaaaaaatgtacccatttccgggttggattccagtatttttgcgttcatattaaagaattccgcacatcccggtacatacatcggcaggacatactgcttctcatgtgccgcattttcccagttgtattcgagaagtcctttgcgtgacatttcttccagaagtgcctcacattttttcttttccagccctgaaattttcacgatctccgacagtgtttttggctttcttaccccaagcttcaatgccaggagtgcttcctcatcagtaagcactccggccagtccccaatactccggatcatttctggtgatctttttaagacccagcttctgcggaatacggtctgtgatctttttgcccagtttcgcaattggctcgcgaaatggtttacccggatccggtgtaaattccgggtacacataatccggataaagctccttatcgagttcttttttcatctctctttcctttcccttctctcttctgttttgttatgatttccagtcagtaacctgctttttcagccatgtagtccatgcttctatgccttctcctgtctttgcactgaccgggaaaatctccgcttttggatttctctggtgaatgtatttttttaccagttccatatcaaaatcaaagtatggaagtacatcaatcttattgatcagaactgcatcacatacttcaaacattaatggatatttcaaaggtttgtcatgaccttccggaacagaaagaatcattacattttttgatgcgcctgtgtcaaactcggccggacaaacaagatttcctacgttttcgagaatcgccagatctacatcttcaatgcccagaccttcgatcccctgctctgtcatttttgcatccagatgacacatgccacctgtatgcagctgaattgcttttgccccggtttcggcaattgcaagtgcatccacatctgaatcaatatccgcctccatgaccccgatacgaaggtcatcttttaaagctgctatcgttcttttcagagttgtcgtctttcctgatccaggtgacgacatcagattcatcagaaagacacctttttctttcagtctgatccgaagctgatctgcctgtctgtcattgtccgcaaacacgctctctttaatttccagaatccttacttttcccacctgtttttattcctttcatcagtatttctaccatttctttttttgcctgttcataagtcagttcattttgatacagaatatctgactccataaaacaatatacagtgccttttaccattgccattactaccggaatggaaacttctcgaatcaagccctcttccatgcctttttcaagatacttttctgcctgttcccatccattgtttactgacctcatcagatgtcggtatggctttggatacttttccgcaagttcgtagattcggctcagtccaatgttgtaatacttttccggcagtgcgcacaaaagcttctccagtttctgcactacattcagacttacatccgcctccagttcttcctgcatactgtttaaatctgccgcataacggtccgctactgctaccagaactgcctgtttgctttcaaaaactgtgtaaattgtttttttactgattccaagccgcttcgccagatcgttcattgtaaatttcaggccgttctgtttaaattcctcaaccgttgcatcaataattttatcccgcattcaatcctccatttggaaacccggaaactctttttggttttctggtttccattattgtaatgccttgttaagatattgtcaatctatattataaaaaaggctgcgtaactttacaatttacaattaagtaaatgctgttacgcagtctgctgtatgtccctattcttattctactgaaaaaattaaaatcctttctcgctcattctttacttcaaacaaatcttctgtgcttatttcatcaacaaacattaaagcttcttccgtcatgagacagcttatatattcctctgacggatagtaaaacattaacagaatttctcttggattctcatagtatgattcataaattctggcaagaactttttgcagtatttctacagaaaacggattaaaaaatagcacctgtccacatcagttggtactgcatattcttctgctcctgtcagctcaaaagatactcttctgcccgataccgcatgttctctgttagattctgctgcactaaaaatacgctcatcatattccacaccgacagatctgcatcgcgtctgataggaaagataaaaacataccctgcccttcccagtaccataatcaagaactgtatttttcttactgatcaacccactgttcgccaggcgttctaataccaaatactgcgtcggctcatacggatatctgtactgatcagaacgagaatcatcccgtccggtcgtctttatcttcaacaatttgtcccattgactctcaatttgattcatatcttctgctcttcttctgtagaattttggatttcatttataatattcacttcacatcctgtcccagtttttccagttcttccatagcttctgtattcttttcaagttcatccttagcatttgcagaataggtcttgaaaaacaatacttcccatgataaatatcctgccatgcattcaaactgtttcctgatcagctcgtactgtacattatcaaccggagctccgccagtcacaatgataccaactttctttcccttaagctgtaatccacgacaatagcatttatcaataaccagtttcaattgtgcagtcattccccaccaatagaccggggttgcaaaaagaatcatatctgctgctgcaattttgtcaattgtcgggttcgtatcatcctgatctacgcaccccttatggcactgacaggctttgcagcctttgcatggagcaatatgtaatttatcaggagaaatcatctcaatctcattatgttcagctgctccctttataaaagtattgattgctgttaacgtatttccctttcttgcacttccattaataattacgatcttcatagctgatctccttttctttttatttgtcacatttaaactttatttgcaaagcactctccttatctttatccgaccaatacttatatcatctgttctcttcccagtaatcctctgcatcctgtatatcatcaaactcatcgacatgatcataataaaaatcttctggatcatcgtaatcatacacatcgtacatatccatgctcttatcatctctgctgtaattgcgttttgatgaagatgaatgcacgaactctacagcattgctaaccctaccatttcgacaagtcgccataaattttttcgctccatccctttatatggtacatctttcttgatttcttctcttttttctttctctttctgttctgtatactcttcatattgcgcttttgtttccgctttcgctgtctgcattttctccgaatattttccagtatattcattttctcgcgggaaattccacgtaagcctgtacagctgctcaattttttctttgtccgcaacacctttacaatattccgcatatggtatgatatatctgctatcttcgtagtctgttggcaatttctccagcagttttatcgcatcctcatactctccagcatctatacacgcattcgcttctttataccattccttgttctggctttctgctgcctcttttgccctcgctctggcagcctcatctcccttgatagcacaaaaaggaactcctgtaactaccaatacgaaagctattacagctataattttcttcttcatacgttaaatactccctgcaatattatttcttccttccattttttagggtgtatactgtatttctataagcacccaatcgttcaagcacccccatatcaaccagttttccaagaatacttctagcacgtctttgttttacttctaatagtagttctacctgatgcgatgtaatctgcccgttttcttttgcaaaatgcaatacctttttctgctgctcacttaaagtatttatcggcacttcatcggcactaatcggcattttatcggcactacttgtcactttatcggcactagcgttttcattatccttatcaattattatactataatcaaacgaatattcatcatctaatggtacaacgatacgaaacacatcatcttctacaaactgcggatctcttcccgaataatacttactatatttaaatagttttcgaactccagaacctagttgatctgcatatccaatatttctgaaaaatgctgcaataattggattctttggatttggttccagattgtcaactgtaataatgccctctttcgatgcacgatttgcattttctacatacatccgcttcttttcaattacaaactttgctgtataactactggtaaattctcggtgcattagcgtattactaatcatctctctgacaattgtatttctcagacttttatttatcgcgccttccaggaaaaacttatctggcaggttttttcttccaaattccagaagttgattataactctcaatcaggttcgttttaatgatttctcgatcatcgtagcgatctacatttactttacgcacaagtgcatccgtaacataagctggagccacatttaaaattacatcatcttttccaagaagcataattgccgcaagattgtatccttcttcacctgtagcaatatcccgaccatataaccctgcacttttcaacaactcctgatcatccatcgtagtccatgggtgctgacccccggtatgattctgcgccataattcgaattttaggcaacaaatccaatcttaaatcttccattcttgcatatggataaatctttctttctgtaaaaatattctgcttacgaatatacatctgcgcaatcgcaccagttgcagttacctttacatcggcatcatccacacgatcataaatcacttttttataactgtgcacctccgcacttggtggaatgtgaacgtgaatgatagtatgattttcatcatattttataatttcaggaattagatatgtggtaggcgaaaataataccggattacttacaacttttataaagttctttaccatatccggagctgccttttcaggcacaccgaccactgttccatcatccagaacgcccataaaaagctctccaccgaaacgatttaagaaagaacatactgtttcataggtgtcattttctattccattgccacagcgtttaaattcaaccgccacggtttctccgattgtaaaaatggattgtagttctttcatgttcataacatctctctctattctttttagtgcaagtttaataaaaagcctcgattttacggcatttgctaaaccgttaataggttacatatatttacaaaacagagttttctggatatgaagcaacttctaagagtccatttctgatgattttaggtacaagaaataaaacgtcgttttttccttatgaaggctttcttgttctctcaaaatctcctacagtagctaacctctcatatctaccaggatcacctgcctctgccggattctaaattccttcgttctgcttatccatagtttggtgctgcttatgctcctttatcgtcaaaccagaatatgatacgagtatctaatttagaaatttctgtatttagttgatcttgtatattttgtaaatccattaatttctctccttaactccctcataatctgttaacacatttctgaaagacgtgattccaaatctataatcaatatccacatttattccatctgtcatattattccaacaatcaatcaaaaaccctctattcttttcaactttattttttatttgtttcatatattttccaggaatttctcctgcaagtatctcacctgtaagtatatcaatcgctgcgctatatctatcacctgcattaacatgcacatgcggtctattatgttttccatattcacgtgattgcatataataatgaatttgtccttctcgccaaatatctccttgaagtgcagaaaatgcaaaatataattgcaaatttccttctatttgaaattttcttagtagagtttctaccataatatccatattttcaatctcaataaaatcttcatgactttttatgcaaatacacggacagcttctgcaaagatcacctatttgcttattcattttctcgcatattgcatttcggatatctgacattgtagtatttggctccaaaatatattctaattcaagctcagagtctctctctaaaatatttaaattttttccatctggatcattcgctgaaagaatactacatatatagccaggaacaggctttttatagtaataaattgtatcagtatatataatctcactttttattttcatttatcaattctctcatatattaataatgtataagtcccagtgcctgatttaaatccacatccagaccatctgtatgctcattccagtatatcaaaaagtctttttgattgttttcaattatttcttttataatcttctgatctttttttcttattttagaccccgtcaactgttctgctgtttttaaagaaaaactcccacttccttccccttgtcttatatcaacatgtacatgaggctcattatgtcgttttccttctctagaatttatataaaaacgaatcccatgatcctcgaacaccgccccagcatctgagcttaccaaaatctgtatatcaatcgtattagatatacccaatttttgcatataaaattctaaatttttgcttttatctactatagaatacctcaaaccatttttcaaaaaatatatttccagaacatcgtattcctctacaaaatcaagagttgtttgttcttctccatacatatccatcctattattcttttcagagtaaatatgccttcgaattaattggtaaaattcctttatagatactgaattctctacctcaaacattatgcttctattattaattattctaagcggttctattatttcttccccaacaattccataattctcactatgcggaattaacagttcatcacacaaacgttcttctgcatatatatgtactgtaaaattaaccgttatcttcattaacaataccccactcccttgcattgctcttttcattctgttcaaagaggagtgtgaatcttatccacactcccccctgcgaacttttcttaaaaatcaatcttataaaatatactgctgtatatttgaacaaattcctttgatgtctacttttgatctgaaatcaaactgaagaaccgttccatttgcaaatgtcataattaattcgctgtcaatatccaaaactcctgccgtctcaattccgaaatataaaacttttgagtatggatatgaaaagtaagacgttttctttcctgtgattccctgcacattgactacaataactcttttgtcagtaaaaaccacctgatcacgtactgtctgaaagcactgaataatgttttcacctgtaaccagcatattgttaacttcagatttcacctatttttgcgcaatttccttaagatttaagaaatttgcatcctctctgattccactgtttactgttgccatacgccttcctccttaagattatttataattctcaaataatttcaaaatcttgcgagtaaatttttctgttccatcttctccgccatattttcttgttttcatatggggagtaagcaaccgaacggttaaagaactttcccagatatgtaattttaatatagcagattgaggtacgagtgtcaattaagtgttagcgcctcttctcctctggaaacactgtgatatccagtttctttgctgttaccattatcatatttcattgttatgccgccttttgtatcacccggtttgtaatagtaatatcctgtgtacgtattatccagctcatcctctcgaaaatcccaatatgttccataattgtaatacaaagcatttctgaacgatgcttcattaaaatactctgcatataaaattgtgccatcttccttattaaaagatacctccagagaatcacctgattctgcatatttttgaagcacaacatctgaatcaaatgcaatattataattcctgcttttcggtgtaccattatattcttctgctgtatattccacactgtgttcttctattagtttaagaagcttatcttctgttgtttctttattaatttccagaaatatcttttgcaaagcatcatattcctgcgtttcctctgcttttgcttcatttgttgaatctgaagcagccacgctccagcatgaaacggaaaaagcaagaccagttgcaatccctgtggcaacaatttttaatatattttttctgattttcattttcatacagtcccttctcttacctaatttccgttttcttcccagtagtcatacgcatcatcgtatccaccatcataatctccgtctccaaattcatcagcccaatcatcggcaaaatcatccgggtcatcatagttactgacatcatacgaatcactcttccaggaagaataggaattaccattgtattttcttggtacaggtgtaggagtatttctcctctttggtgtataatgatatttttgtgattggttaaaaagctcaaaactgttataaattctttcaccattggaactgcctgaagatttctttttgctgttttcataaatactattaatatgatcccaacagtactgtgttcccgcatcttttagattccaacaccccggcatttcacagaaactatcatatatcttcaagctcacaatcatcagcaataataatcccatggtcactgcgtatattattttgaatttctttgattcaaaaaatggtggtaaaaacacatagattgcccccttctctgtcgatttactaaataataaacttttgagtattctagcttgctacttaacgaaattccaccgcacatgaataataatgaatttcattttttattgatacttctcttccatgagattccaaatacaaaaaggatgccaaaaaaatagagcgtttttttctgttcagtgcttatgctaaaatttatacatccacttctaataaactgaataagttttaagatctcgataatttgcagataaatattcacttactttatctactctaataaatttttgttttttccattcatatatttcgaaataatcattgatttttagacataaaaaagtatctttgccaaacattaactcatccctataagtcaataaatttttaaacgcatttaaaattccagatactacaaacacatttccctctgtgatattgcttaccgatgaatcgatcttttttgcacttccaagtctgattgcacgtatcttaggattagaaatcaatcgctccaacgcattatcaactgccaaattagcttgagatgcaactaaaacacgcttatttcgtataaccaattgataaattgcctctgcaataacagttgttttccctgttccgggaggcccctgaattaaacatacatccggaacagacaatattttttctaccgcttctttttgtttttcgttgatatctgaattctgccatgtacttattttcttgatttcctgtggcgttcttgctttattaatgtcaaaaagccattgatccagtccctgtgaagcagcctttcccataacaagattgttgactgcaccttttaaacgatgaagcaatgcaaaatctccaatttgcgatgttgcaatatagccatctgcgtaaagctctccggccattgtttcctctacatcatcctgaatgcttcccattcggcgtatctgacgttcaatcattgtatttgcattcactgtgaattcaaaaaccaattccatcacataaggttcaaaataatttcgattaattccagaaatcagggatcttgtacctgaatctcggtcattctcatatttctttgcataatcctttaatgtatcccattcatatgtttcaagtattaaactaagcacagtcatcacaaaaaacgtgcacaaaaaaagacaccagcctcccagccagtgtcttttcaaaaactttcttattcattctttctacgccatcatctcatacgatcccaccatcacgggcatggtcacgattgacaacagcgtcgtcagaacatacagtgaactggcgtatgccgcatctttatcgtagagctgtgccatggaggtgacagtcgcacaggcaggtgttacagatgccagatacacggtcaggagaatctgttttgcatccattattccgataaatgcacagattattttcatcaggaacaatacaaatatcggatatacaataagtcttaaagctgtagaaacatagtttctttttcggttaaaaacagttttaagcggtacttctgcgatgaccatcccagccagcagcatgccaattgggccgatcatattattcatcatattcatgacatcctgtacaccggatggcagctggattctgccaataaacagtactacacctactataatggagatgatattcacattcagaagtacctttttccattccagtttatcttcttcgcagagcatatttttgcagtgtgtccagattaatataagctgtactgcaatgtatgcacttgaataaataacgtactcctgtccgagaagttcctgcaccagcggaatgacaagaataccggcatttgagtagattacggttgcccgttcaattgcatcaagatgcaggatattttttaacaatgctgtaagaatcaggaataaaatgtgtaccgccactgctgccacgcatgccagaatcagacccttctggacatctggtgtgtatttcacctgaaatgcattaataatcacacacggaatgaccaggtataccatgatcacagatacgcttttgctctctgaggatttcataagtcctgcctttacgactgcatatcccataagcatgattgcaaacaacttcgcgatttcttccattaacaataaactgatttccatttctagcctctcttctccgtcataaactcccgtacaatctccagtccgccacttggtacgcagaacttctctctgctcttctggcactctgcataggtttcttccagggcaaaccattccacggcctcgacttcttctttctgcagaaccagatccgcgatatctaccggttgatcatagatatatacaaaagccagttcttcatctcgaaacattttgccatgaaattcttttgcaaacgaaatcgggaatgttccggcgaatacaagctgctccggtgtggcttgtattccaagttcctctcctaactcgcgaagtgctgattccagtggttcatcgcctgcctggatgtgtcccgccgacgaagtgtcaaattttcccggaaaagagtctttattcatggaacgcttctgaagcagcacttctgttcttccatatttctcccgtatgatccatatatgtgccgtcctgtgtggaatgccttccgcatgcgctttctcgcgggttacagtctcgccggtcggatttccctgtgtatctatgatgtcaaatatttcttccattatctttgcctttctctgcctgttttccgcaacttatctcgagttcatttttcatctgcgcgcgtgctttccgcgcgattccggaattgctgttcataatgcttgcacgtgtgatcttgtcgttgccgaatttctgtcggatttcgtccatagttgcgtccagttttcggtgacgttctttcttttcattatcttcaaaaagtgataattgctcgaagctctcgtctgtaaggtttgtaagtgctactccgatcagtcggagcggttcgcctttccaggattctgtaaagagttttttcgcgttcctgaagatttcatctgtcatatccgttgcattggaaagtgttgtctggtgcgacttatttttgaaatcaagcgtacggaaagttactgatacagaagtacatttttttccttttcggcgcattctggtggtgaccacatcacattgctccaaaagaatcggaagtacctgctctactgagacaatatcatcattaaacgttgtttctacactgaagcccttggcttcttcaggctttgctttgactggtgattcatcgattccaagcgcgtattgatgcagctgatgtccggctttattccctaataatgcctgtatttctgactcacttacatgtgccatatcaccaatcgtgcgaattccggcctctgtcagttttttctcaaaagcttttcccagaaacaacagatcacgcaccgataacggccacatcttagtcgggatttcctctggaaaaagtgtatgtaccttgtccggtttctcaaaatcggatgccattttggccagcaatttgtttgtagaaattcctacattaactgtaaatcccagttcgtcccgtatcttatcttttatctcatgtgctgtttttatcgggtctggataaatcaatgaagtgcctgtcatatccagaaaaacttcatctatagaaaaggattccatcaccggtgcatacgacgcgcagatttctttaaatgccctggaacatttgatatacagttcaaaatcactttttacaatgacgagctccggacatttccgaagtgccattgccaccggttcacctgtcgtgatcccatatttttttgccggtatggactttgccacaacaattcctgtacgcttcttcggatcaccgccaatacatgcaggaatatctcttaaatctgacagtccctgcttcactcttcgtgctgactcccatgaaagaaacgcactgttgacatctatatgaaagattaaacggctcattttttgcccacgtcctattctttcttctgatatttcgttctcaaaagccacttctgatcgatcacttttatttcatttccaaatcgaatatgcagggtcacagatcctgtcgcctgctcgattttttctatacagccttctccaaacttgggatgctgtacctgctccccgaccgtatactgaacgatacttgcctgactgcttttgtgttcctgctgccttcggtaggtatcccgtatcgccactgtcttatcatgaatcggatttttgagtttcttttcatagtcatgtttcatcaacgcttcgccagctttgtagtatggtgtcggcgccgctccgaccagggaacaacaatatttccaggcacttccatgaagtcccggctgccactgatattcccttgggattacaatatgatgttccatataatgggcatactcatgtttataaaggtccatacggtcttctttactcaggggattttttactccatatcccacaaaaagcagagaaaaatggaagtgttctttttcatgatgtccggttcttgtataggatcccagtgcatctgtttcaaatccaaaagtgattggaatctgtgccccgcgaagatgaaatttcttatccagttcacggtataatgcccggatctgcgcagtcagaatcgtagtttctttttgtaaggatgcatataattctgtgtaatctctgtcactcatatcatcttattatttaaggaaatattttctcagaaggtacgttggtgtacagctccatgcatggcagtaactgtttacgatactgcttccatatggagactctgccggattttccggattgtagagctcccagaaagtatccgcaccgtgattgatcatgccgccccagtaatatttcatataatccattgcctggtcttttttgccgcacatcaaaagtgcttctacataatgatggttcatgtatggagagaccattgctttttccggtttcagctcatccagcttatcaagcattgctctgccttcttcaatgctgactgcacctgcaaggatcagccatacctgacttgcgtagttgatctgtttttcttcgccacttacaaacaggcctgttttctcatccaaaagatattttctgactgctgcagtcttttcttctgcttcttttttaagctcttctgctttttctgtatcaccaaggatttctgcgattttctgcactttctttgcgcagtagatataaacaccctgcatagctgtctgtttgttcaggccttcggtccagtcaatgaatccccagaaaccttcaccgtttttcataagatttttttcgtcaaactgctcgcctgcgatctcaatctggcgatatgcacattcacttaaatcctgcagagtatctttatcgccggatgcttcataataatctagaagtgttgcaccaaagaacatggaatagtccagaagaaaggtatcatctacgatgaatttcggctctgtaaacaggcatgcacttacctgaccattgtcttttgtctgccctgcaaacaggtacaggcatcgttttacgagatccatgttatggaatgtttcatagtttgcaagtgcctgaagtcttaagtctccgagccacagacggcggtctctcttcggtccatcctcaaatacggactgcatgcagttgtgcagggtacgaaggctgaccctgtccagtttacggattatttcgtcatcactctctaccggtttcacatcttccatgcggactgaagaaacactggtgcagtatacatcttccactaccatctgccatttcagagatgtgtcgattgcctcgatctccatataacgaaatgcgtatcttcttggaagtttcaattctgccggaaggacatcgatatggataaattcctcctgaatccatccacggctgatccatccgtcataatcttttgaatcctcggtcatttcttttgcgatctcaccgaatttcagtctgaaaaacgccggtgaatcctgcggacttcctacggaattcagtttcagagtcacatagcctacctgatgatctccgaaatccaggcagattttatccccttttgcaagatgacaggaagaaagattctcaatctcatctctcttatggacttccggaaaaatctcttctgtttttacaatatctactatagcaacaggacgtaccactgtctcgataagttttggcgtacatgcctctgctttttttacaaattcatcattggttactcgaaccatatttaaatcaatacttactgctggcattatgtcatttcctttctaaattcatgcagactgaatctgcaaaatatcaaattattttaccttttattgtaaaataagctataccattgcgtcaatattttttacctatctttctctttacaaacctttcacgctgacgtattctataacaggatgaagaaaatataatgtattattgaggttttattatgtctgaaaatacgcaaaaaaaggcccgttccattcaaatggtaacgggttctttgtggaaaaatatttttttattcagcattccactgatgtgctcacagcttctggaagttgtttttaacctgagcgatgttgccgttgtcggtcggttcgcggattacaaagcactcggagcagttggctccaccaccctgctggttactttatttgtcggatttctgattggaatgggcagcggtgtaaatgtacgaactgcccatgcacttggttccggaaatctccagaatacagaagataccattcattcagcacttattctgtgtgcattgatgggactgctggtaggcgctgtctgtttcttcttttccggtggaatgctgaaactgctacacaccaaagatgatctgatcggacaggcatctctttatctgaagatttatgcgatcggacttcctgccatgggtgtgtataactttggtaacggtgtcttaagtgcacgtggggatacaaaacggccactttattatctggctgccgcaggtgtactgaacgttatactgaacctgtttttcgtcattgtattacatatggctgccgcaggtgttgctactgccactgcgatcgcacagtatgtttctgcaatgctcatcatggtacatctgctccgccgaaaagatgaatgtcatgtttcactgaaaaaaatccgttttcacaaaaaagcatgtattgacattctggtcatcggtatcccggccggtattcaaaatgcaatcttcgcgattgcaaacctgtttgtacagagtggagtcaattcttttgatacttacatggtttccggcagtgccgccgccaccaatgccgacacgatcatttacaatgtcatgtatgcgttttacattgcatgttccagcttcatgggacagaattatggcgccggaaataaaaaaagagtcctcagaagttactttatcagtctgttttattcattcacgatcggattgatccttggactgctcctctttatcttcggacatcagttcctgtctctgtttgccacggatgcagcagtcattgacgccggcatgcagcgaatcaaaatcatggcattttcgtactgtttttcgtcttttatggactgcacgatcgcggcttcgcgcggaatcggaaagactatcatcccgacaatcattatcatcatgggatcctgcgtgttccgtatcgtatggatctacaccgtatttgcctggattcataccatcccagcactgtttcttctgtatctgttctcctggatcatcacatccatcgcggagattacttactttatcatcatctacaggaaactttgatcctgtagatgatttttttattttatcaacaaataagtaaacttatgtagataaaatttcttttctcctctggtatcatgttaaattattatcatttttaaaaatttcattgtttttttattgcttttattgatgaattatgtataattaactctatgagaagttggaacgttccacttcttagatgttaaagaagtcagcatatagatggctctattaaagaagagaggtaaatgtaagatggcaaaaatcgatttaactaagtatggcatcacaggaacaactgaaattgtgtacaatccttcttacgaagtattattcgaggaagagaccaaagcaggtcttgaaggatttgaagtaggccaggaaacagaacttggcgctgttaatgttatgacaggtatctacacaggacgttctcctaaagataaattcatcgttatggatgagaactccaaagatacagtttggtggacttctgatgaatacaagaacgacaaccatcctgcaacacaggaagcttggaacgcttgtaaagaaattgcaaaaaaagaactttccaataagaaacttttcgtagttgacgcattctgcggtgctaacgctgatactcgtatggctatccgtttcatcgttgaagttgcttggcaggcacattttgttacaaacatgttcatccagccaacagctgaagagcttgaaacatttgagccagatttcgttgtatacaatgcttccaaagcaaaagttgaaaactacaaagaacttggtctgaactctgagacagctgtaatgttcaacattacatccaaagaacaggttatcattaacacatggtacggtggagaaatgaagaaaggtatgttctctatgatgaactacttcctgccactgaaaggtatcgcagctatgcactgctccgccaacacagaccttaacggtgaaaacaccgctatcttcttcggactttccggaacaggtaaaacaactctttccacagacccgaaacgtctcctcatcggtgatgacgaacacggctgggatgacaacggtgtattcaacttcgaaggcggatgctacgctaaggttatcaaccttgacaaagattctgaaccagacatctacaacgcaatcaaacgtaacgctcttcttgagaacgtaactgttgataaagatggaaaaatcgacttcgctgataagagcgtaacagaaaacactcgtgtttcctacccgatcgatcatatcgaaaaaatcgttcgcccgatttcttctgcaccggcagctaagaacgtaatcttcctgtccgcagatgcattcggtgtacttccgccagtatctatcctgacagaagctcagacacagtactacttcctgtctggatttacagcaaaacttgctggtacagagcgtggaatcacagaacctacacctacattctctgcttgctttggccaggcattcctggaactgcatccaacaaaatatgcagcagagcttgttaagaaaatggaaaagagcggagcaaaagcttacctcgttaatacaggatggaacggaactggaaaacgtatctccatcaaagatactcgtggtatcattgatgctatccttaacggagatatcaacaacgctcctacaaagacaattccttacttcaacttcgaagttcctacagagctgaatggtgttgacacaggaatccttgacccacgtgacacatatgcagacgcggctcagtgggaagaaaaagcaaaagatcttgctgcaagattcatcaagaacttcgctaaatacgaaggaaatgctgctggtaaagcacttgttgctgctggtcctcagttataatttcatattaaataacaaaatccaggggctgccgtttaacgacagccccataatttttatctcccggtgagatacattttatttaaatatgaaaaagaaaatactacgaaacgagatgatgagacatgagttggtataacgaagctattttttatcacatttatccacttggccttaccggtgctcccaaacagaatgagtacacagaaccggtacatcgcctgaacactcttcttccatggatcgaccatatcaaagaaatcggatgcacagccctgtatatcggaccgctcttcgaaagtgtcggccatggctatgagacaacagattacaagaaactggactcccgtcttggaacaaacgaagatctgactgcttttgtaaaagcctgtcatgacaaaaaaatcaaagtaatttttgatggtgtattcaatcataccggacgcgatttctttgcattcaaagatattcagcagaatcgtgaaaattccagatatctgaactggtattgtaatgtaaatttctggggaaacaatgaatacaacgatggattttcctatgataactggggtggatacaatctgcttgtcaaattaaaccagagaaatccagaagttcaggattatatctgtgatgtgatccgttactgggtttctgagtttgatgtagatggaatccgcctggatgctgccgatgtactggattttgatttcatgcgtgcgctccgccgtactgcagaagaagtcaaaccggatttctggctgatgggcgaagtaattcatggagattacagtcgctgggtaaatggagagactctgcacagtgttacaaactatgctctgcacaaagcactttatagcggacataatgatcacaactatttcgagatcgcccatacggtaaaatatctccagaatatgggaaatctggatctttataatttcgttgataaccacgatgtagaaagaatctatacaaagctatccaataaggcgcactttactccggttcatattctgctctatacccttccgggcgttccaagtatttattatggttctgagtttgggatcgaaggacgtaaagaacgctcttccgatgacagtctgagaccagcacttaatcttgaagattacgaatctgccctcagtgataatccatgcactgcacttatcaccgccctcggtaagatcagacagaatacacctgctctgagctatggaagctacacagaactgcagcttaccaatcgtcagtttgcatttgcacgtgatctggacagcgtgcgtgtgattgtgactgtcaacaatgacgacaatgatgcctggatgaatcttcctgccggaaatgctgttgaatatattggcacactgaccgggcagaaagtttctgtagaaggtggacacatcaatgtacgcgtgggtgcaaacagtggcgaaatctggataccatcagaagaaacatctgttcctgaaacattttctgaaaacaaggactctatcgttgaagaaacacctgttactcaggaagaagtcaaaaacgaaggctctgcagaaaccaaaacagccccagcttcctctataccggaagctgcaagtacaaaagaagacaccgatagaactcctgcttctgctgaaaaagagcctgtcaatttcgattcgaacaaagctccggaagatatgtccatcgaagagctccaggctggcatcctcgcaaagatggcaaacaacggtcccgtcaccgatcagatgaagaaaacagtttatgacaatatatggcacgattctctggtcaactggttcaagagcttctgctgattcatattataaaaggcatactgtatcgcaaatcgacaattctttcttaagcgatgcaaaaaaagaggagtatctcacacaattttcgtgtgattactcctcttttcttttatattgctctgttatgcacattccccgtcagtctctgtcgcaattctccaccgagcatcgtcacaaatacacttactgcaaatacagaaatgcatctgtccagataatctgtcagaaactgtactgcaaagatacttccggtcagtccaagcggtgtttttgaaagaagctggaccagaatcgaagatcctgatgaggtcacacctccaaacaatactgcattaatcacagaacttacaatcgttcccggtacagtgatcagtgctgcagcaaacaacacttttactttctttacggataacttacgaaaaacaagtccactcatgatacctgtgatcatacccacaggtgcaaaatacaacgaatagatatccactgtcatacccataaaaattccactgatcaggttcggcagcataccaaaccacggtcccagaactgcacctgtcagaatggttccaatactgtccagataaaccggcagtttcataaagagtgcaatctgtcccccgacaatattgattcctactgccagtgccaccagacagatctggtaaacattgatcttgttttctgtataatcttttttgtttcttttcattgttatcttcattctgtcacctctttacagctcatgcagaagtttaaattcatccttcttccatctgcttccatcattttttctaagtacacgttccataaagaatgcaaaaaatctttcagaatctgtttctgtaagaatcctgctattcggttcttttttccagaagttcatagaatctacaacagtctgaccacgacaaactccgtcagttgcaacgactgtaaagctatcaaatccgtcgcacatggatcggtcaataaaatatgccactgccagtggatcattgatcacgcaaccaataatcccctcctgttcccagtgaaaatccatataaaatcctgtgatcttacgaataaattctcccatctccggatccaggcggcacatatattccagcctgttcggtgtcaggacaatttcacgcgtcacatccagtccaatcatatgaatcttgcttcctgcctttgcaaaaagatcatacacaacggcagctgcatccggatcacaccagtaattatactcagctaccggcgaacaatttccatgactcttgaaacttcctcccatggataccatctcttctacattagcgatcagttccggctttctcgaaaatacttttgccagattcgtcatcggaccaagtgcgataatggatattttttctctctccagaagttctgtcagaaaatcaaccgcattcttcttctcatattcactttccacttccggaagaaagctttctccaagtccatccatcccatgggtatccctcgcatcaatgtattcttcccggagcggaacttcttctccaatatagattggaatatccattcttccaagctgcttcagaacctttcgcgcattagccgcccccatatcagatggcacattacctgatactgttgtgattgccagaatatcaagttccggagaatttgcagcaagcatgattgcaagtgcatcgtcaattcccggatcacagtctataacaattttatgcataaaaaaacttccaacctttccttcttccaggtgatttttataaaaatcctccacagaaaaaggtatcgacgatcggaagatacctgcatgacctagttttttatactgggagggtttcgaaccagttatgaaatttataaaacatttcataaaaatctacttatgaaactttttgtagtataacaaaaagaactccggaatgcaagtatatttttacattccggagtaaaattttagttactgtgtatgaaataagtatttactgattttattcaaataacttcttcaccatatccgcgtcaaaaatcacagaagatacatgatttacttcaatctgatacagagcatttgcagcaatgtgttctgccgcctgttccagatcacggataccggtcgtatcagcaaactgctcgatcactgcatcaagtccatccggagccactacgcactcttcttctttgaggctcatgcgtttcaatactttcggaagtgcaaatttggagaaaataactttcttttcttctgctgtgtaatccggaagttcaatgaccgcaaaacgggacattaacggagcactgatctgtgctttgtcgttggctgtcgcaatcggataaacaccgacagtcggaaccatacattccatatagttatctgtaaatccaaggttatcaaggagtgtcagaagtacatccgccggattaccatttcccttgccattggttgccttatccagctcattgataataaatacaagattggactcgcctgccatggaaaatgcttccataatgattccaggctttgcattggcatagacacgggaacttccggtaagctgctccggatcattaatagaactcatatccaatgttgtccacggaagtttcagaatacgtgcaactgcgtaagcaatctgggatttgccggttcctgccgggccaaccagaagcagcccgtatgccggaagtgtatgcgtacggttaatctgaatgatcgtctcaatgattctctgttttactttttccattccatagagttcttcatccagaatacggcgcgcctctactggatcaatggattcaaaatagttatttttccactgaatattcatcataatggacagtgctctctgtgcatgtctgcgttcttcctgcgacacctcatgagatctcgcaacagcaaggtttcttcttgcccagagacggatattgtccggcatggtccttcctgcacaagtcataaaatccgtgatgctctgaatgctggtcagcttcatatcatcgccgtcctcatcttcctcatctccatccggaagttctgtcggtgcattacttgccagaagacgttcgatcataaactgcaggaatccatcttctgctgaaagttttccggctcctccaaacgcagtttcacgaatcttatagattgcatatccatcttctgtattctgtccagataatcgtacactaatatggttttcgcccagccattttacgaggctcacaaaacgtgcatcaattttgagaatatctgccgggaaaacaccgtccttttctttgaattcaaaagaagatttctggtttggattggaaaagacaccacaggaatgatgcttccactgacgacttttattatcaatgatcaggatcggtttctccggtgacggtactttttcattcgactggaacgtcgtataagtacattccggatctttcttttctgttttgctgttgctgaaatcaaatactggcataataaactgctgctcctcttttattgtttgtattgttgcaatgattaccatgaatctgtaatcacttatctgtctttaattctgataaaactcaccgctgcacacattatagattccccgtggagtaacgcgtatctctggaatgaccggcagagccataaaggacagagtgataaatggcgccatagcatccggcacacccatctcgtgtgccttgcggatcattcgttccagttttctatgactgtactgaaaacctgcatcactcatcagtcccattaccggaagttccagtgtatcatatacatgatgatctgcaaccagtgtataaccgccctgcgtacggatcagttcctgtacagcaagatacatatcttcatcattgtcaccaattacaatgatattgtgagaatcatgggatacacttgacgcaattgcgccaccctgaataccaaatccactcacaacaccgacacctgtttttccagttgctttgtgcctttcaaccaccgcaatcttctgatactgttcatctgcggtgaatactcccatttcatgaagtatctgtacatttttacggacagttataatttcgccttcctgcattccgactacattgaatataccatccggagattccagtcgcaagtcttcctttgagaattctccaacatgaactgtatttttcagttctgatggacattcttttacaatgctctctccgtcctgatcaatttttctgcccttatagtaaacatcctggattgtcatcttttcaagattatccacaacaagcatatctgcctgatatccaggtgcaatcgccccaagatgtgttaatccataacattttgcagaattgatggttgccatacagattgcatctatcggattcattccgagtccgatagccttacgtacattatggtcgatatgaccttctttttcaatatcttcgatatgtttatcatctgtacagaagcagaatccctctccattcatctgattctctacgattccattcacaattgctttcagatttcttgcagcactcccttcacgaatatgtacaatcatgccatttcgacgctctttcatcgcatatgcaaaatctgaacattcatgatctgtagcaattccggccatcgcatatgcctgcagatccatatcagaaagaaatggtgcatgtccatccctgactttatcactgaacagttccagtttccggtgcatggcttcatcaccctttacaactgatatgtagtccatgacttcacccagtccgagaattcttttttttgaaagataaggttccatatcctgtgcagtaagcgtgcatccattatcgtcgatcgcagttgccggaacacaggatggcatcataacaaaaacattggcatccacgtcttctgtctgattcaaaatataatcaatgccctttaatccggacacattggccgattcatgtggatctacgataaacgttgtcgttccatgcctggacgccactgttaccagctctgccggagtcacaagtgtagattccagatgcagatgactgtctataaatcccggacagacatacctgccgcccagatctgtttcttcttcaccctggtagtttccgattccaacgatcattccatcctgaatcgcaatatcaccttccaggatctctctggtaaaaacattcacaatacgggcatttttcagtacaaattctgcttttctcagtccacgggttacttttgaacatttctgatatttctgtaacttcataaagcccacactcctttttattactgccctttacagcagttctatttttaccttattctattattatctgtgaaacttccggcagaaatttaatccagtttaatcccagaaagcgcctgtgcaaacgcattgtttactggttctgctgcttctttctgctgttttttcagatatttctgtacgtctcttttgttgacaccggctccttctttggttcttctggcctggaaagatgacagtttctctttatatccacatacacatacaaatgtttcttctttgcctttgaccagcatctccattcgcttgtgacatttcggacatcgtgcatttgttgtacgtgaaattgtctctctgtatccgcattcacggtcctgacacaccagcagcttactgttcttgccatttactgcaagcattcgtttaccacagttcggacagatcttattcgtcagattatcatgacggaaggttcctgttcctgtcttgatctcaacaacgatctccttggtatattcgcgaattccatcaagaaagactttctgtttcagtttgcccttggatatatcagacagtttcttttcccagtctgctgtcagttccggcttcttaagctcttccggtacaagttccagaagctgttttgctttggaagtcagatagatttcattgcctctcttttccataaggaaggtgtggaaaagtttttcaataatatctgctctggtgacaactgtgccaagtccaccggtttctcccagcgtctttgctgcttgtgtatcttttgaggacatatatttcaccggattctccattgccgccagaagcgttgcctcagtaaaatgtgccggcggcttggtcttacctgttgtcagacgaacactgcctatcggaagcttctctccctgtttcaataccggaagcttctggtctttcagtgtctgctcttcttcgtcatcgtccgtgcttccgccttcgtaaacttctttccagccagcactcacaaccgtcttgccacttgccacaaaactctgtcccgctgccttcccttccatggaagtctgttcatattcaaatggagaataaagaacactcaaaaatctccgcacaaccatatcatagattttgcgctcttcatttgtcatatgatccagctgtacaaactgctctgtcggaatgatcgcatgatggtcactgacctttttatcatccacgaaacttccgtttgtatggattggtttagtaagcagcgcaccggcaagttttcgatatgggccggttccacaggctttcagtctctctttgatcgtcgggacaacatccttgccgatataacgggaatccgttctcggatacgtaagtaccttatgattctcatataatctctgcatgatattgagtgtttcttttgcggaaaatccatatttctggtttgcttcccgctgcagagtcgtcagatcataaagtccgggagccattgttttcttaggctttctgtccacagatacaagttccagatccgtattggaaatcttcttctggatctcctccgcacgctctttctgaaaagttcgatagcttccgttcttcgcatctttccaggtccactgtattccaccagcctgcaaagttactccaaagtaatcctctggtttaaacttacgtatttcttcttctcttctcgcaatgattgcaagtgtcggtgtctgtacacgcccgcaggaaagctgtgcattatgtttacaggtcagcgctcttgttccattgattccaaccagccagtctgcctctgctctggcaactgccgcacgataaagattatcataatctctgccgtctttcagattgtgaaatccgtcacgaattgctttatcggttactgaagatatccacagacggcgaattggtttgtgacatccggacttatccagaatccagcgggcaaccagttctccctctcttccggcatcggttgcaatgatgatatcaccgatatcttttcggaacagctgtgtcttcactgcctgatattgtttggaagtctgtcggataacgacaagtttcattttatccggcatcatcggcagagtttccatatcccatttcatatatttcttatcatattcttccggatctgcaagtgtcacaagatgtcccagggcccatgttacaacatattctttgccctcaaggattccgttacccttctgggtacaatggagtactcttgcaatatcccttgctacagatggcttctctgctattaccaatgacttcatacttctgcctctttctcaggttattatccgttgctgtctgttttcccagcaagttttcagttaaatctgctttgatgtgagtatatcatatcccaacaaaaaaaggaaggtatgtcaccttccaatcttatatcctacgccacgcactgtttcaatcagatctccggcgcttcccagcttctgcctgagtgtccggatatgtacatccaccgttctgctttcaccatcaaattcatatccccatatctgattcagaagctgtgttcttgataaaaccattccgctgtttttcagaagcagcaccagcatctcatactccttcaatgtcagattaacaggttcctgatccaccgtcactatatgtcttcccggacacagatacaggttttccagatgatattcttctgcgcctttatcctctgcccgacgaagccgtgccttgatacgtgagatcagctccatcatacgaaacggcttcgggatataatcatctgcaccgctgtccagtcccatgaccacatcatattctgtgcctttggccgtcagcatgattaccggaatcttgcgtgtgtccggtctggtacgcagttttcgtaaaatcgatattccgtcttcttcaggaagcatgatatccagaagaatcaatgccggcacttctttctccagttctttccagaacagggacggtcgttcaaatccttttgcatccattccctgactctttaatgtatatactacaagttcacgaatactctcatcgtcttctacaagatagatcatttatttcctcctgcctgtctgtttcttcacaaacaggttcttttttatctttttgcaaagtataaaaaatgaacgttaaatttccggcctgcacagtgttaaatgtttgtaaatttctgtcgaacatgctatgataaacgagaacataagggaggaactcatgtactattttattataaatcccaactcccgttccggcaaaggtgctctgatctggagggatctggagaacattctgcgtgaacggaatattaaataccaaactttttttacagaatataaaggacatgctgttaagctttctgcttccattactgcctcgattccggaagatagtcaaatcaagctgattgccgttggcggtgatggtacgatacaggaagtcctgagcggagtaaaagatatttcccgtgtcattttcggctacattcctaccggatccggaaacgatttctgccgcagtatgaaacttccacaggatcctatgaaggcacttgaactgattctttccgataaacgtccacatctgatggacgttcctcatatttcctgtggttccagcagcagtcgtttcgcgatcagctgtggaatcggttttgacgcagcggtatgccatgaagttggcgtcactcctatgaaaaaagtcctgaacaaaatcggcctcggcaaactggtctatctctttgtcgcattgaaacagttgcttttcctgaagccatcttctatgacactgctcatggatgacaataaaaaagaagagttttccaaagtatattttactgccatcatgaatcagaaatacgaaggcggtggattcaaattctgtcccgatgccagtccttccgacggctatctggatgtgatcgttgtagacagtttgagcaaacccaaagtaatatgttgtcttcctactgctttcttcggaaaacatacacatttcaatggtatccacatttttcgctgtaaaaaaattgatatccacagtgaagccagactggccgtacataaagacggagaatccgctggtcttttgcatgatttttctgtatgtatggaaccgaaacaaatcaatatgatctcatagaagtaatttccgcaacgcaaaaaacttccccataaaggggaagttttttagttgaatccatagaatttctgacatactttgtaagcagctacaaacattttgcgtccacctctgcccggaagattggctgcacgtcccagaatactgtaacgcagtttatgatacagccagagatcctgttcacgaatatactccagcatttcttttttcttatccagtgcttcctgagtacctgcacgtaccagcatgatcgaggacacggtcgtaatgatatccagatagctgagcatatatttcttaagatgtttactgtcaaactgacaattatggaatgcgtccgccatcaatttattgacacggatctgctggtcaattctcttaatcatcaccttttcattgacagactgatcatctcttccgataaaataacgataaaaattgacatccagatagtacatgttcttcacaaacggaagcggctcaaatgcaaacaggttatccacatagaatgtatgcttcggcagttccaatccacattcgtgaagcagttttgtacgataaataatagaatgcatcaacagatatttaccttttgacatatgcacactgtcccatccgaaaatttcattcaccggaagacaacatctgtactgcatgactttttttctggaagcaccctgtttttcatatacaaaattgctgatcagcatatccagtgtttttggtcctcttgtcagttcttcaagtgtttttaagatttgtttatatgcctcttcatttacccagtcatcactgtcaacaactttgaaataaaggcctgtcgcattacggattccggcatttactgcttcaccatgaccaccgttttcctgatgaatagcttttatgatcgtcggatatttttcggcataagcatccgcaatctcagcagttcggtcagaagaaccatcattgaccacaatgatctccacttcttctccaccttttaacaaagattcgatacatttctccatatatgcttctgaattataacacggaattgctatactcaacaatttcattttccagattcctccttcatgtattttacataagctctgaatgcagacggaatcgcgtactgcttttcagactgttttttctcagcaaaaataaatggcaatcctctgtctgtgtccagcgctgccacccgaatcagatatccggtcatcctccattcaatatgcgaaaaaatatgctttgcatccggaagtttctcaatatagagcggttccagctgcatattttttaccttatccagcacttcctcccgtgtaagatggcccaggagattcggaagctcatataatccagcaagaagacctttttccggtcgtttctgtatagcagttttctctccgtcctgaatcacaagcactgtcctgttttgcagaatacgctccttcttcggtgctttgaccggcagctcctctactgtcccgtgtctgtatgcaagacagtactccgacaccggacatgcttcacagcgtgctgatccattcggcacacaaaccactgccccaagttccatcagcgcctgattaaaatctcccggtatatcttccggcattatctccaaaaggctttcttcaatctgccggcgtaccgactgtttcataatatcctgtctgtcctctgtaattctggatatcacacgaagaacatttccatctactgccggtaccggaatctggtaagcaatggatgcgatcgcacctgctgtgtaattcccgattcccttcagactcagcagttcttcgtaagaagccggaagttttccctcgtattcacaaactaccgtccgggctgccatctgcatattacggacgcgattataatatcccagaccttcccagagcttcatcagcttctcttccgggcattctgccaaagcctggacatctggaagctctccgataaaacgctgaaaataaggcttcacggcctcaacccttgtctgctgaagcataatctccgatacccacgtatagtaggcattgttctgatctctccagggaagaatccgtttattctgtctgtaccagtctgtaagaggttgtacgatttcattcagcatgcttctgtcttttatctgatcatttttcatcttttaccctcagtatgttttagtataacataatttcagccaaatgccagttgattttttttattttaccggatagaatgttattacttgggattatacctgtaaataattatctcccattactaaaattaatattatttttgatacgaaaggaccctattatggacagtattatttttgatgttgatggaactctgtgggattcaacagaaagtgttgctcagtcctggaccgcatatctgcgggaaaaagaacatatggatattaccctgacatcagcccgtctgatgacactttttgggcagactctgtctgatatcgcacgccagattttccctgactgttcagaagcagaacagcttcgccttattgatggatgctgccgggccgaacatgaagctctcttaaaaaaatgtgccccactttatgaggatcttgaaaaaatgctgcagatcatgtataagaaatatccactctatattgtcagtaacagtcagagtggctatattgaagtttttcttcagacatcaggtcttgaaaaatatttcaaaggtcatctttgtaatggagataccggtctggacaaaggctccaatatccgtaaacttgcagacacatatgatctgaaatcccccgtgtatgtcggtgatacgtttggcgattaccaggcatgccagaaagcaaatgttccttttatcttcgctgaatacggattcggagaagttccaaaaccggatgcacacatccgcaaaccaatggatcttgtcaatatttctttataaattctctcaaataaaacaggcacggaagatttttatctcccatgccttgttttatttatttcttgatgcatttctttttcaaatataccacaaatcctacaagaatcgcaagaattgcaagaatataaataatctttgcagtaagacttgttgtgtaggaatctataaatgtcacgataccaaacagaatcaatgtcactccggatcccttagtcatttttttctcatcatacttttctttgcgaagttttgtgtttccacccttcagaaaaatatcaccatgtcctgtcagaagcatgattccaacgatcaatgctattcccgcaaggataaaatcaaatgatctgtccattttttatctcctgtaattatatattagtaaaagcatacgattggcacaccatactgtatgatatcatacagaactgctgcattatccggtggaagattgatacatccgtgagatccgcctgtaagataaatatcaccgccgaattcatctctccatgacgcatcgtggaatccaatacctccatcaaatggcatccagtactgtacctctgattcatattcataagttccgtctgctttcatggttcctctcagtacatccggacttttcttatagtacagtgtaaagatacctgcatgtgtctgacgatcagcataactcatgtttccagatacaaaatctgactcaaagatatcggaaccattttgataataatacatatgctgttcacttaaatctacttctatataagtgtcacccagatcattcactccgtaagaattggccgtctgtgaataaacaggctccctggtcgtctgtgtaccagactgaatttcctgactcagctgagcagcctcggcagcctgatcgattttccagccatatacagagctggaaacgtaaacgtttctgccacttgtggtctggaactcacgctccgtaccgaccgtatcataagtagctgcaagctgtgcaacataatctgcaacatgctgctggaaggaattatcgtcccagatcagctgacctttctcatcaaactgtagccagtctttgatcgtgtcaccattcagagttgttgtctgactgccaaatgtataggtaatacttgcttttgtataattgttgcatgcttccagtgcagactgcagtgccggatcatcctgtgtaacatctgcattcacatatgcttccggtgtatcactgaaatttaccgaagtctgtcctgcatctacagcagcattcagtactttatatgcttctttgatattcagtttacttcccacggtttccggtacgatcacaaactgtccgttctgatatgcaacatatgcattttccggttctgtctgattctctgcctgagcacagctgagagtcttaagctgttcttgcaactgtgttctgttataccctgtattctcggatacagtataacttttctgttcatagagtcctttgatccattcatatggcttctgctgtttcagaagcttcagaacctctcctgtagaaagatactgatagctgatatccgctccggaaatcgtctgtggtgcctgatctctggctgaaacttcaatggtataattctcaaacttttgtttgaaaagattttctacctctgctgccgtcatctgagaacagttcacaccattgatccacgtaccttcaaaaaatctgtccgcaaaataataacttgcagccgcataagcacacccgccaagaactatgatcatcaacataataaggccaaaaatccgcgcccctttgtgttttttcacaggtttaggattctgatactctggttttgctgatctgttcttttgcgtatttgtttttttggattttttcttcctggaagttgtctgatccggcatttccatatcatctaccggaacatatacaaccggacctggtctggcagatttgcgatgatgtcttaccggctgtggatctggttcttcctctgcagaatcatcataatctccaagatcatccatctcatcttcgtccgtttccggtggaactatgattttatccatggttgcattgatttcttcttcaatgcctgtattctcatccgacactccagaagtgtcttcctgaagttcgtctttcatttctttgttgctcatttaatatactccctgaatataaacaattgaatacaaccatctatttatcctgttttttcctgtaacgtttccattataacatacttctgtatttttgcaccttaatttattgcttttttatattctttttccgagagtttcatcattatagtaaaaaacccctgaatcttaagactcagaggtttattcatggttctgtttattttagatattgtaattatttctcaaccaggagactttctcctgtcatttctgcaggctgttccattcccatcagctgaatcagagtcgggatgatatctgcgaggcatccgttctctctcagagtgtatttcggatcagcgtttacaagaatgaacggaaccggattcgttgtatgagcagtccatggctctcctgtctcataatcaatcagctgctctgcatttccgtggtcagcacagataaacatctgtccgtcaacttctttgagagcttctactgctcttcccacacatccatcaactgtttcgattgctttgacagctgctgcctgtacaccagtatgacctaccatatccgggtttgcaaaattgataatgatcacatcatatttatcagatttgattgcatccaccagcttgtcacaaacttccggtgcgctcatctccggctgaaggtcataagttgcaaccttcggagatttaacgaggattctgtcttctcctttgtttggttcttctactccaccgttaaagaagaaagtaacatgtgcatatttctctgtctcagcaatacgaacctgtgtcatatcatgagctgcaagatattcaccaaatgtattcttaagaagtactttgtggaacgcaacctgtttgttctggattgtttcatcgtaatctgtaaagcagacatatgtcagatccagttttttagctctttcgaagcctttgaattcatcatcacagaatgctcttgtgatctcacgtgcacggtctggacggaagttaaagaatactatagaatctttgtcctggatctttgcaaccggctgtccgtctttttcgattactgtaggaagtacaaattcatctgtcttatcattgtcataagaagcctgaacagcagctgctgcatctgttcccttaacgccttcgccttctgtcagtgctttgtatgcaagctctacacgatcccagcggttatctctgtccattgcatagtaacgtccggaaacaactccgatctcaccaactccgatttctttcattttagcttcgagctgttcgataaattccttacctgatgccggcggtgtatcacgtccgtcaaggaagcagtgtacataaactttcttaagtccttctctctttgccatctcaagcagtgcatagagatgtgtattgtggctgtgtacaccaccatcagaaagaagtcccataaaatgaatagcggaatcattttcttttgcatttttcattgctgcaagaagtgcttcatttttaaagaaatctccatcgttgatttcttttgtgattctggtaagctcctggtatacaatacggcctgctcccatattcatatgccctacctcggagttacccatctgtccatccggaagacctactgccagtccactggcgtttccttttacaaatggatattctgccattaatttatccataacaggagtttttgcttcgtagattgcatttccctcatgtttgtcgttcagaccataaccatccaggatcattaatacggttggtttcttactcataatgttctccttttactgtatactttttctgcattttacagcagtatttactggtatcatttcctattatatagtaccaaaaatttagaatttttcaaggattttatcagaaaagcttaacggaagtacggatagtttgtctttcgtatctgcctggagctgttcgagccagcctccgcagattgctgtcagaagttcctgcatcatcccgcgggattccggagcaaatttttccacacgtttcaccatcgcagccagacttttcagtcctccggactgtacttcactcagattctcgtaaccggatgcctgtaatgttgcaaaaagatcttcaatcagaagtctcttctgttccgtatccataccatcgatccatttgtgcaggatttcaataaatcggagtgccgttttgttcagactgtctcgccgtaccagcgccggtccctgcacctcccaggaaaatccatcatgctggagaagtcccttactggagcttgcaacaataactggttctttttcatgctccagaagcgtccctataatagaatactccggaataatgcgaataatcttcggcatcatttctttcatttccggcagctcttgaaattctctggagaatccgggtccgtcattagaatagatttcaagtatcttttcatgagcacttttgcacatcaccgagccataaatcgcaaggtttccacctttggaatgtcctccgactctgagcattccatctgtatgttccgagattttctgcaaatactctatggcccttttttgtgccggaactacacctgtgctgagattaaaatcttctttccatcctatgatcgtatcatccgttccgcgaaaagagacataggaagtgccgtcctccagaacaatttccattgcagcaaactgctgctcagcttccgttacaatatcattcacataatttcttaccacacattttccaaatctgacagacttcgccatttccatcatcataaacggagccaggcggataaaagatttatccgcctccagttctttcatcgtatgaagtttcataaattcttctgtcagttttttcagtccgattcccttctgttttgtcactgccggaattccatccagattcacatatgaaaaacatgcaagaatcaaattgtccacttcgttaaactgcgactgttcaaaggaaagatcccctctccaactaatgtaatccataatatttcccataagcaaccccttttgcgaaattttatactccgttcacaaagcaacttaaggtattactgatctatacgatcttattctccatatacacgaagcatgctgcttactttacgtactgagcttcttccactcagatcttccattgccgtacggaaatcgccttcgcgaactttggctgtgatgacaacaacttcggcactttcttctgcacgggcagctttctgaatgatctgtgctacgctgactccatattttgcaaagacagcagtcatttcagccagtacaccacaacgatcttctacgatcaatctcataaaataacgattataagtatctgccatcttctttaccggaagttctttataacaggtacatccaattcttgcacagcagtttgccttaatatttcttgcaatatcaaaaagatctcctacaacagcgcttgctgtcggaagctcacctgcgccacgaccatagaacatggcattttctactgcatcaccattgacaaatactgcattataagaatcatttacagatgcaagcggatgactgcttggaatcagcattgggcaaacatatgcttcaattccctcttctgtattctttgcaactccaagaagttttatgtcacagcccatttctttggcatatttgatatcttttgctgtaatcttggtaattccttcaatataaacgtcatcaaaaacaactctggaattaaatgccacagatgcgagaattgccacttttcttcctgcatccagtccttcaatatctgctgtcggatcggcttctgcatagccaagttctgttgcaagtgccagtgcatctttgaattccattccatcctgggtcatctttgtaagaataaagtttgttgtaccattgacaatacccataacttctgccatatgattgccggcaagacattctttcaatggacgaatgatcggaattccacctgctacagctgcttcaaacaaaaaatctacatgatgcacttctgctgcatcaagaagttctttgccatatactgcaatcagatctttgtttgccgttacgacatgtttacctgcatttaatgctgccagtatgtagcttcttgcaggttcaattccaccgatcaactcgatcacaatatcaatttccggatcatttacgatttcatcccaattgttggtcagaacggccggatcttcaacctttgcagcagctttttccagattacgtaccaggatcttcttgatttcaatctgacttccaagcttcggaatcatgtcttctttctgcttctgtaataccttatatacacctgttcctactgtaccaaagcccagaagggcagcacgaatgatttttttatccattttaaaataggctcctttctcctcgtcccttatctctttattcttatattactgttcacaggtaatatcccgcgaggtgtttttccatgaatatggcaaagtcccgagacatacggggcaaaatgctataaccgaaggtgatgtggaatgcattttgaccaagctactgtgaacgaagtgaacagtgaatattttaccacttgtgtttaatagtattgtataaagcggattttgtcaagcgcggacatttgtacgtctctggaaacaaaaaaaaagccagatacctcttacctggccggtttgaagtatctgactcttaaaatcatcttattgataattatttgtagttaacgatctttccgaaatctggtttcagggaagcgccaccaacaagtccgccatcgatatcacccattgcgaacagttctgctgcatttcctgcatttacagatccaccgtactggatacggatagctgctgctgtatctgtgtcgtagatctcagctacacagtcacggatacctttgcagatttcctgagcctgttcgcttgtagctgttttgcctgttccgatagcccagattggttcgtaagcgataaccatagttttagcctggtcagctgttacgttctgaagaccaactttaacctgctgacggatccagtccatagtgatgccctgttctctctgctcaagagattctccacagcacatgattggtgtaatgccatgttcgaaagctttaagtactttcttgttaacgtcttcgtttgtttctccgaagtaatctcttctttcggaatgtccaagaataacatatttaacaccagcatctacgagcatagccggagcgatttcacctgtgtaagcacctttttcttcgaagtacatgttctctgctgctacagcaatatttgtacctttgcaggcttcaacaaccggaacgatgtcgattgccggaacaccgaatactacgtctacttcatcgttctgtacaagtggtttcagagtttctactaatttaactgcttcgcttggagtcatgttcattttccagtttccagcgataattttctttcttgccatttttattatctccttttttatttatcattagctgctgctacgcccggcagttcctttccttccaggaattccagagatgctccaccacctgtagagatgtgagtcatcttgtcgccatagccaagaatatttacagctgcagcggagtcaccaccaccgatgatagttgtagcttctgtatcagcaagagctttagcaactgcttctgtaccatgagcaaagttcggcatttcgaagcaacccattggtccattccatacaacagtctttgcatcttttacagcatcacagaaaatcttttctgtctctggtccgatgtccattccttcccagccatccggaatgcatccacgttctacaacctggatattgcagtcgttagagaaggcatctccgattctgttgtcaacaggaagaagaagcttaacacctttttcttctgcttttttaagcatgtctaatgcatactgaagataatcatcctcacagagggaattaccaatgtgtccgccaagagctttggagaatgtgtaggacattccaccaccgatgatcagagtatccactttatcaagaaggttgttgataacagagatcttgctggaaactttcgctccaccaaggatagctacgaatggtctctctggattttctacagcatttccaaggaatgcgatttctttttccatcagatatccgacaactgcggtatctacatatttggtaacaccaacgttggagcagtgtgctctgtgagcagtaccaaatgcatcatttacgaatacatcgcaaagggaagcaagttctttactgaactcatcaccgtttttggtttcttctgcacgataacgtgtattttcaagaagaataacttctccgtctttcatgtcagctactgctgcttttacggtatcatcaacaacaaccgggctcggaacgaatttaacttcctgtcccagaagctctgtgagacgttttgcaacaggtgcaagagaaagttccggtttcggctctcccttcggtttgccaaggtgtgagcaaagaatgatctttccgccatctgcgatcagcttcttgattgtaggaagagctgctaccagacggttctcatctgtgatttttccgtcctgcagaggtacattaaagtcacatcttaccagaactctctggccttttacattgatatcatcaacggattttttgtttaatcccatgctaatattcctccaaattcataaaaaatgggcccggtccaaatcagaccggaccctgactgagtctatttgtgtcattgcaaaatgcaacaacttactccacactttaacttatggatttaattaagcgttcagaagttttccaaagtgtttgattgtacgaaccatctggcttgtgtaggagttttcattgtcataccatgaaacaacctgtacttctgttgtgccgttctcaagtggcagaaccattgtctgagtagcatcaaacagagaaccaaatctcataccaacgatatcgctggatacgatttcgtcttcgttgtatccgaaggattcgttagaagctgctttcatagctgcgttgatctgctcttttgtaacgtttccttcaactactgctgtaagaattgttgtagaacctgttggggttggtacacgctgagcggatccgatcagtttgccgttcagttctgggataaccagaccgattgcttttgcagcacctgtgctgttcggaacgatgttaactgcagctgcacgagatcttctcagatcaccttttctctgcggtccgtcaagtgtcatctgatcacctgtgtaagcgtggattgtgcacatgataccggatttgatcggtgcaagatcgttaagagccttagccattggtgcaaggcagtttgttgtacaggatgcagcggagatgattttatcttcgtttgtaagtccttcatggtttacattgtaaacgattgtcttaaggtcgtttccagccggagcggaaataacaacatgtttagcacctgcatcaatatgagcctgagctttgtctttggatgtatagaaacctgtgcactcgagaactacgtctacaccgatttctccccaaggaagttctgcagcgttagcttttgcatagattttgatttcttttccgtcaactgtgatggaatcttctcctgctactactttgtcagccagagcatatcttccctgagttgagtcatattttaataagtgagccagcattttcggggatgtaaggtcgttgatagcaacgatttcaaatccttctgctccaaacatctgacggaatgccagacgaccaatacggccaaatccattaattgcaacttttactgccatgataaattcctcctatgaaataaatggttgattatggcgtttgttaaagaaacgtcaacctattgcatattgtatcgaatctcgtacaaaaattcaaggggattttataaaaaacatcagaaatttctatttaaaaggaaatgaaaccatagcatatgcgatttttgcatgctataataatgtcaatccatacaaaggaggatacaaaaatgtcaaatcagatcttatgggactgccatatgcattcttctttttctgctgactcagacacatctatggaagatatgatccgcgaagcaatctgccggggtctcaccggcatctgtttcacagagcatctggatcctgattacccacctacaccggataatgaaatatttgagctggatcttgatggatacagagagactctttttagactccgagaaaaatatcagaaggaactacagattcatttcggtattgagcttggccttcaaccacatttgaacagttattttcacaagcttttgaaaaccatgccgtttgatttcgtaattggatcttctcatattgtacacggatatgacccttattataaagaatattttaaagggcgcgaagaatctgcatgttaccgggaatattttgaatccattctcgaaaatctgcatgcattttctgagatggatgtatatggacatattgattatattgtacgctatggcccgaatcagaataaatactatacttatgaacgttaccaggatattcttgatgagatcctgcgcaccgtcattgccaggggacggggaattgagctgaataccggcggtttccactacggcctcggagagccaaatccctgccgtgcagtcattcgccgctatcgcgaacttggtggtgagatcatcactgtcggtgctgatgcacatggaccggaaaagattgcctatgatttcgataaggctgctgcaatacttgcagactgcggttttaagtactatactgtattccaaaaccgtaaaccggaatttgtcaaattataattttcagataaagatacaaaaggaggagatccatcatggcaaaaaaacgtcttcagaaaaagcgtgaagctgccaaaacttctgctttccaggctgctgctgcgaaagcagaagccccgaaaataactacaaaaaaagttcaaccaattaaggttgaaacaacaaagactgaacctgttaaagtcgagactaagaaaacagagcctatcaaggttgaaacaaagaaagtcgaacctgctaaagttgaaacgcaaaaagctgaagctgtcaaagttgaaacagctaaggtcgaatcagctaaggttgagactaaaaaaacagagactgccaaagtcgaaactacaaaagctgaaccagtcaaactggaaaataagcgtgatgatgatcacatctattgtgaacgtcttgcccgtcatctggacgagctgaaatggctctactgtgaactgtatcaggataacccatatgtcacaatgcatctcaatgatcttctcaaagtcctgaagaaattctatgatatgagaaatgatgccctgaaagaatctgatctgaatcgcgaaaaagatccgacatggtataaacgcaacgatctcaccggtatgatgatgtatgtcaacgcttttgccggtactctttccaatctggaatccaaactggattatatacaggaatgcaatgtcaattatctgcatctgatgccactccttgactccccgaggggacgcagtgacggcggttatgcagttgctgatttccggaaggttcaggaagaacttggaaccatggatgattttgcagcactgactgctgcctgccataatcgaggcatcaacgtctgcctggacttcgtcatgaaccatacatccgaagaccacgaatgggcaaaacgcgcccgtgcaggagaaaaagaatatcaggaccgttactttttctttgataattatgatattccttcattatatgagcagacctgcccggaagtgttcccgacaactgcacctggcaacttcacctggctggaagaccttcataaacatgttatgactactttctatccgtatcagtgggatctgaactaccgcaatccgatcgtcctgaacgaaatgatctttaacatgctgtacctggctaaccagggtgtagatattgtccgtctggatgctgtaccatatatctggaagcagcttgggacgaactgccgtaacctgccacaggttcacaccatcgttcgtatcatgcgtatgatctgtgagatcgtatgccctggcgttcttcttctcggagaagttgtcatggctcctgaaaaagttgttccatatttcggaactgtcgaaaaaccagaatgtcatctgctgtacaacgttacgactatggcaagcacatggcacacagttgcaacaaaagatgtctccctgcttcgccgtcagctggatatcatctccgaacttccgagagattatgtattccagaattatctgcgttgccatgacgatattggatggggactggattatgaatatcttgaaaacttcggtattcaggaagtacctcataagaaatatctgaatgatttccttacaggaaaatatccagattcttttgcacgaggagaactttataatgatgatccgcgtcttggtgatgcaagactgtgcggaacaacagcttctctctgtggtattgagcgttttggatttgaaggaaatcaggaaggtgtggacagagctgtccgttatgatattacactgcatgcattcatgttctctcagtccggtatcccggtaatctacagcggcgacgagattggtcaggtgaatgattattcttacaaagatgatccggaaaaatccgatgattcacgttatcttcacagaggaaaattcgactggaagctggctgaaaaccgtcatgatcctgctactgtacagggcaaacttttccctatgcttgataaactggagcatatccgttcaagccatggtatattcaacagcaatgtgccaattcataccattgacacctgggataattccattcttgcctttgtacgtgagaatgatgaagaaaaatttatcggaatctacaatttcagcgaaaatgataaagttgcatggatcaatgaagaagatggtatgtacacagatcttatctccggacgtgagatggaagccaaaggtgtgcagattcctgcattcggatgctattggctgtgcagaaataaacaataatttttaagtacataaatatttaaaaaggctccggtcagattgaccagagcctttttattcgaattcctattctatttgcgtaatttatcaataaatgcagtaaattttcctgggttttctttatccagagaacgtgcatagattcccttcagccagacagtgatcacatcgatcagtaccggtgcaaaggtcatcaggatgaataccaagatgatcattccaaaatccaaagaaccaagagaaagcagtttctggaaaataacggccgccgcaaagaatataaactgcataccgtaaatgatcgtcttacgataggtattcagtggtgcataaacggtcttcaatgcagccatatagttccatcccgtaacaagaacacaggccgtattcaacatttctgtggaatgatatacattctgacaaacgagcatgaccgcaaacacacacgatgtaatcgtgagtgctgccggaaacgcattaataaatacatgcctcaggaacgtatgatcaatcttctcgtaattgttttcctgtgcaagcaggaatgtcggaatacctaccgcacacgcgctgatcagtgacatctggatcggttcaaacggatacgtatttccaaagaagatcgtcagcaatgacaacataacggaaaacatcgtcttgatcaggaacatggatgccgccgtacggatgttgtttacgactcttcgtccctgatttacaatatgcggcatagatgcaaaatttgaatccagaagaacgacatttgcaatattctttgcagcatcacttccctgtgccatggcaatactgcagtcagcctctttcagggcaagaacatcgttgacaccgtcaccagtcatagctactgtatgtccctgggactgcagtgcctgaaccatcgcttttttctgctgtggcgtcacccgtccgaacacgctgtactctgcaactgcatcctgaagcatctcatcggatgtcaatgtcgtcgcatctacatatctgtcggcatttttaagtcccgcacgctttgcaatcgctgcgaccgtcaccggatcatcaccggaaatgaccttaagatctacctcctggctttcaaagaatgccagtgtatctggtgcttcctctctgatcacatctgtcatgagcatcagtgcaagcggttccagtccctctggaagttctgtcccttctaccatctgggaactatgcgccaaaaccagtactcgaagcccgtcttcagcatatgcctgacatcgttctgtcaactcctggttatcttctggaaacaggaactgtgctgctcccatcaaatatgtgcctttttcttcaaaaacggcaccactgtattttctgtcggaagaaaatggaattacatgttccagtgtcataccctgctttgccggaaaacgtttacgcaatgcatcgatcgttgcattctgatctttgagtacgtacatcatattgcacatgatctcgccgacttcgtccataaatgccgaacctgcgtctgtttcatctgccgaaacctctgttgcagaaacttctgttatttctgtatcggatacttcggctgcctgtacttctgtctgtctggattccgtatccatttctgtcagttctgctgattccgtaatctcggccaatcctgcatcgacttccgcatccgtactctcatctttagaaactctgtaaggctccacacgctccacgcacatggttccttcggtgatcgtaccagtcttgtccagacaaagtgtgtcaactctggcaagcgtctcaatacaatagagctcctgcaccagtgtcttcttattagcaaggacaagtgctccaagtgtcagtgcaacgctagtcagaagaacaaggccttccgggatcataccaaggactccggctaccatacttacgatagaatccttaaatgtatctccaacaatatagtactgcttgtaaaacaacaacgctccaatcggtacaataatgatactgatcaccttcagaatcgcattcagagaattcttcagttctgaattgtgacgcttgaattcttttgcctcactggtgatctgggctgcatagttgtcctttccgacatggatgatctggcagtttgcctctccggaagtcacaaaacttccggaaaaaagctcatctcccacattcttgggaagattgtctgattcaccagtcaaaagagattcattgacctctacactgccttcaagcaccctcgcatctgccggtacctgatcaccggtcttgagacagaccacgtcatccagtaccagttcttctgtcggaacggtccatttctgtccttcacggataacaactgattttctcgctgtaaggattgccagcttatcgattgttttcttggcacgtatctcctgtgcaataccgatcagggtattgataacaatgatacatacaaaaaatgcattcttataagagccaaccagaagtacaagcaccagaagtacaaggttcagaaagttgaaaaatgtcagtgtgttttctcttatgatctgcttataggtccgggtattcggattctcgtccgcattaaccttgccttctgcgattcgctcatttacctgttcatctgtaagtcctgtcaacatttcacctcacaatttactgtttgctacaaattaatatttccaaacagcattctctattttaccgttggcgttctccccctcacagccgaatttattaatattcttcttcctcttcaccctcgctgatgtcagactttggtttgtccagtccctcgatcacgattccatgtttctgtgcataatcccacagtgcagcatggattgcttcttctgcaagaagtgagcagtgtactttaaccggcggaagtccgtccagagcttccataacggctttatttgtgatctgcattgcctcttcgatagtttttccttttaccatctctgttgccatactgctggttgcaacagcagcaccacagccaaatgttttgaatttgcattctttgataatatgagtctcatcatcgatgtcaaggaacattctcatgatatcaccacatttggcattaccaacagttcctacaccacttgcgtcttcgatttctcctacatttcttggatgctgaaaatgatccataactttttcgctgtacataatataacttcctcctgttattttcttcttattttcttcggtctatcatcgtctgcccttgatgaacacttttatttattactgctgatgtttcttgataaaatcttcatataatggagacatacttctcagatactgtacaatttctttcagtttatctactgtaaaatcaagatcttcttttgttgtctcatcgcttaaagtaagtctcagagagccatgtgcaacctcatgcggtacaccgatcgcaagaagtacatgagacggatccagagagccggatgtacatgcagatccactggaaccgcagatgccgttctggtcaagcatcagaagcatggactcaccttcgatgaactggaagcttacgtttacgttgttcgggagacgttttactctgtcaccgttcagtctggaatatggaatctcagtagtcagacgattgatcagataatctctcagttcgatttccttagcagtacgttctttcatagttcttactgcacgttctgctgctgcaccatatccaacgattccaggaacattctctgtacctgcacgacgtttacgttcctgtgcgccaccatgtacgaaggatttgatcttgacacctttacgaatataaaggaagccgattcctttcggtccattaatcttgtgtccacttgagctcagcatatcaatgttgtattcatccacatcgatcggtacctggccaaatgcctgaactgcatctgtatggaacaggatgccatgttctttggcaatacgtccaatttctttgattggctgaatggttccgatctcattgtttgcaaacattacagaaataaggatggtttccggtgtgattgctttttccagttcatccagacggacaactccattctcatccacatcaagatatgtgatctttgctcctctttctttttccagatattcacatgtatgcagaatagcatgatgctcgatcttggttgtaataatgtgattacctttggacttgtatgcttcaaaggtagccttaagtgcccagttatctgcctcacttccgcctgctgtaaaataaatatcttcttttctggtattcagtgcatctgcaatctgctgtcttccttttgttacagcctctttgctcttctgtgcaaaatcatagatactggaaggatttccataatattcagaaaaatacggaagcattgcatcaagaacttccggagcagttttggttgttgctgcgttatccagatatattaatttactcatgttttttcctcctgcttaaaaaataaatttttacattttttcctgttgttttttccggctttcttcaatcaactgatccagcatcatagtatctaccgcctgtgtgatactgtcgttgattcgtttccacacatatttcgtcacgcagatatcgtgattctcacaggtgctctcatcttccattccggaacactgtgcagcttccagacttccctccagaaccctcaggacatcacccacggaaatctctgctgccggtcgtcccagccggtaaccaccaccggcacctctggtactatccaccagaccagccttcttaagcttcgccataagctgctccagatagctgtctgagatattctgtcggcttgcaatactctgaatggaaacggcttctgtttcacaatgcagacccagatcaatcaatgctttgagaccgtatcttgcccttgttgacagtttcatccactcacctctttaattcctagtgttttcgtcggatttatttcaaatcatactttagcagaaaccctctgttctgtcaaggaggttttctgcatatactgtcaaaaaagtcacaggacgtttttcatgtcgaaagaacgatttttcaaaggaactttccttctgacttctgctggcctgatcagccgtattatgggcttcttttatagaatattcctttcacataccattggtgcagaaggaatcggtctgtatcagctggttgttcctctgcagcatctggttcttgccatgaccaccttcgggattcagacagcactctcccgcctgatatcctctcacacggcacttggagaaaaaaaagaagcacaggactgtttccgcattggtacctttcttgctctttttctctccggcatggccgcatggagcatttttactttttctcatttttttgctgtacagattttaaaggaaccggctactgaatcactgattcgcctgctcgccctaagttttccctttgcttccgtccatctctgtgttaatagctactatcttggactgaaaaaagcttcttttcccgctgccacacagattctggaacaggccgtccgtattttttccacctgtctgctctggcagatctgtctatctcgcaatattgctgtcaccgcaatgattgcagttgcaggaagttttctctcagagcttgccgctgctctgtgttcttttatctgtataagtctgaacagttctgtatcttcacattatatagaaaaacctgtgcaaaaaatatctgagatcgggcatatagcacttcccctgactctgaaccggcttcttctctctgtgctggcagccattgaagttgtattgattccccagcgtctccgtatgtatggtctctctccatccgaatctttgagtctgtatggagtttttaccggaatggctcttccctgcattctttttccttctaccgttaccagctctgcatctgtcattctgatgccctctgttgcagaaatgcaggcacttggacaccgcagaaaaatccgctatatcacacgtaccacctgtgctgcctgtatccttctcggatctttatgcaccattgttttttactttttgggaaattttgccggaaccatacttttccataatacagatgccggactctacatccgtacactttcatttatctgcccgtttctttatacaaatattgcgcttaccagtgttttgaatggtctgggaaaaaccggaacaacacttattcacagtgtcctcgggattctcctccgaatctctttcgtaatatttgccatccccgtccttggtatacgtggatatctgtatggacttctgcttagtgaaattctgctcagtcttttacatatttatgcactgtctcatatggaatattagcaattacacatggtaactttataaagttttgcgttaaatatataacatttctatcgacaacctctttttaatcgtttataataaacgcgatatgtccgatgctgtcagacaaacggggaacgccccgcatatgcaattatgaatataccattatatccggtaaattccggatgcgaggaggaaaatatgggattcacttttttaaagaaactgcctacacctgccgagatccgcaaccagtatcccatcgatgctgcaattcaggaattgaaagcaaaaagagatcaggagatccgtgatgtctttacaggcaaatctgataaatttcttgcaatcatcggtccatgttctgccgataacgaagatgctgtttgtgattatcttcttcgtctgcgtaaagtgcaggataaaattgcagacaaagttctgatcattccacgagtttataccaataagccacgtactacaggtgaaggatacaaaggtatggttcatcagccagatcctgaaaaagcacccgatatgcttgccgggctgattgccattcgtaaaatgcatattcacgcaattcaggaaagcggtttcacctgcgcagatgaaatgctttatccggaaaactatcgttatctttccgacattctctcttatgtagctgtcggtgcccgttctgttgaagatcagcagcatcgccttaccgtcagtggtatggatgtgcctgccggcatgaaaaacccgaccagcggtgattatagcgttatgctgaactctgtcgttgctgcacagggttctcatcgtttcatttacagaagctgggaagttgaaacaactggtaatccacttgcacataccatccttcgtggtgctgtaaataaacatggagaggctatcccgaactaccattacgaagatcttcgtcttctgtgggaaaaatatcaggaaaagaatctccagaacccggcagttatcgtagacaccaaccactccaactccaacaaaaagtatgaacagcaggttcgtatcgccaaagaagttcttcacagtcgtatggtcgatcctgaacttcataaactggtaaaaggtttcatgattgaaagttatatcgaacctggcaatcagaagattggcggaaatcatatttatggaaaatccatcacagatccatgtctcggatgggaggaatccgaaaaactgctttacacaattgcagaaatgtgttaattactaagaacgccaaaaggcagagccgtttatctgactctgcctttttaatgtctgggatgtgctttcatatacacatctctcattcttgctacattcattcccagataaatctgtgtagaagaaatatccgaatgtccaagcatttcctgcacgctttttacatctgctccgttctgcagcatatgtaccgcaaaggaatggcgtaatgtatgtggtgtaatatctctgtgaattccggcatctaccgcatatcctttcaaaactttccagaatccctgtctgctcatagatttccccgaacagtttgtaaataaagaggattcttttttgttcttaacaaaaaagcctctggaatgctccatatattgcaaaattgcatttctgctcacattgccgattggaatgatccgctctttttctgaatcatggcagatcacatatcccatctgcagattaatatctgtaatctgtaaatgaatcagttcactgactctcattcctgttgcatacatcaattccatcatagcattgtcccgaatacccttaggtgtgttcaagttcggttgttttagcagtctgtctacttcttctaccgacagaatttccggcatttttttctctaattttggcggctttagtgtttcagacggatcttcctgcattttccctgttcttatcatataatgatacagtgctcttattgatgcaatatttctggaaattgtagataatgccagattctccttctgcaattccttcagataaccttgtagatccgtcttggtaacttctgaaaaatccataatcttctgattacgaagatatcgggccagttttttcagatcacgctcgtatgaaatctccgtgttctgcgatgccttctttgcctctcgcatatacgcaataaaattttctattactttttccattcccattacttcccgtattatattaaaaatttatcttccccaaatgtatctgtattatacttgcaattttacataaaatcaaatcttttttctgtgctaaacccttttaaaatcaggcttttccgtgttttctacaaaatatcgcagatttattgtcaaccaatactatatatggtaaaacaacctttaaaatattttcaaattctgtattaaaattttcattatgaccggattgcagtaaacctctgacagaattccagcacacaggacaactgcacatatcagcattttcactatataagtcgatacctgtcccgaaaaagagctatggtttttccaaattctcatcgaatattcatatacattcttacttacagcaaaaaaacatggtacgtaaataataaactgaggaaacatcagtcctatgccgatcaaaccaccgtgaaatccgaactgaaggattgacatggtcatcaacatacccattcctattcccaacaaaatcattccacctaccgcaaccaaaaccccaaatatcgtcaggccactgccagcaacaagaagaaacaaacctcccctcattctcagcactttccagaaatactctctgctccctttttctgcataaattcccataagatataatgcagatactgtattttgtttccactgcattttatatatcagattcggaagcacaatcccaatgacacacccaataaaaaacagataataagccggtaattctctgtttttatttactgatagtttttgtttcatctcctcaccccataccagtctacggagtttttctcagacttagaacataaaaaaaggatatgacacttctcagcatcataccctttctgaacttctatgtccccgaaagattacttcgcataatctaccgcacggctctcacgaatcacattaactttaatctgacccggatattccagttcagcttcgatctgtttggagatatctcttgccaacagaaccatatctgcatctgtaacctgttccggtactaccattacacgaatttccctgcctgcctgaatagcaaaggacttgtcgactcccttaaattcatttgtaatgtcttccaactgtttcaaacggtttgtgtaagtctcaagtgtctctcttcttgcacccggccttgctgctgaaattgcatcagctgcctgaacaatacatgcaacaagagattccggttccacatctccatggtgagacgcaactgtattgatgacaactgcggattctttgtatttcttacaaagatctacgccaatctgaatatgtgaaccctctacctcatgatcgatagatttaccgatatcatgaagcaatccggcacgttttgccatacggacatctacaccgatttctccggcgagaattcctgaaagctgtgccacctcgatagaatgtttcaaagcattctgtccatagcttgaacggaatttcatacgtccaagaagtttcagcagttctggatggataccgtgaacaccaacatccattgctgcgttctcaccatcttcacgaatctgtgtttctacttctttctgtgctttctctaccatttcttcgattctagccggatgaatacgtccgtcaacgatgagtttctccagagccactctggcgatctcacggcgaatcgggtcaaaagcagataaaacgactgcttccggtgtatcatcaatgatcagatcaacacctgtcagtgtttcaagagtacgaatgttacgtccttcacgtccgatgattctacccttcatctcatcacttggaagctgtacaacagaaattgtagtctctgcgacatggtcaactgcacatttctgaattgcatttaccacgtactcttttgctttcttgccagcttcttccttggccctgttttccagttccttgtacattctggcaacatcaactttgacatcatcttctacacttctgagtaactcgtcttttgcctggtcggaggtcagaccggaaattctttccagttcctgtactcctttttgttcaagttcgtctactttcttttctcttttttgtaactcagcaacttttgctgtgcactctgcctcacgcttctctactgcatccgcttttttatcaaccgattcctcttttgataaaacacgtctttcgtatttctgcagctcggatcttcgttccttggtttccttctcaagttcatttttcgttctgagggattcttcctttacttccaataaagcttctctcttcttcgtctcagcagtttttaaagcttcatctatgatgcttcttgctctgtcttctgctgtgccaacaacttcagcatcttttttagctttgttgttaaccgcaaccttgcaagtaagaggaaccgcaataagcagtgcgaccgctacagcgacaattgctacaataattgtaattgccacaggagcacctccttatttagttttcattgtacaaatacaacaatacaagtttagctgtttttaggatttatgtcaagtttttctacataatttttaactcataactgttcaggtacagaaccattatgagatatccatttcttccaatacggaaaaaatatctccggaccgaaaaccacgtcgtgccagatacccatacagccgtctcatttccctctcatcaaggctgctacctggagcatatttcttctctaccatctgccgaaggagtttcctttcatccggcatctccagttctgccgcttcgtcccatgcactctggatcgtctgacggtcaatccctttctgctgtaattcctggaatatcttctggcgactcttgtcatgaatcctgtacataatataattcgtcgcatatctcgcatcatttacatatccataatccttcacatatgcgacagcatctgctgccagagcttccgaaaagccggcacggagaagccgatcatataatcccttctccgtgcggtccatatgttccagaagcttcagtgctttcttacgaacttctttctgctgctgttccatatctgtcattcaattattcctgctcttcttctgcatcctgcgctgccggattctgctgtgcagcctcctcttcaggaagaagatgatactggattcttacctgtttttcgatttcttcacagatttccggatgatctttcaggaaaatcttcacattctctcttccctgtccgatacgctctccattgtaagagtaccatgcaccactcttattcaccacattacattctgatgcaagatcaagaatctcaccttctctggaaatgccagtaccaaacataatatcaaactcagcctgtttgaacggcggagcaactttattcttaacaactttgaccttgacatggttaccaaccatctcgccaccctgcttcagggtttctgttcttctgacatcaagacgtacagaagcatagaacttcagagctcgtccaccggtcgttgtctccggattaccaaacataacgccaactttctcacgaagctggttgataaaaataaccacacagttggatctgctgatcgctgcagtcagttttctcaaagcctgcgacatcagacgggcatgcagtccaacatggctgtctcccatatcaccctcgatctccgccttcggaacaagcgccgcaacagagtccacgattacaatatcaacagcccctgaacgaaccattgtctcagtgatctccagagcctgctcaccattatccggctgtgaaatatataaattgtcaatatcaacaccgatattctttgcatacaccggatcaagtgcatgttctgcatcaataaatccggcaattccgcctctcttctgcacctcagctaccatatgtaatgcaaccgttgtcttaccactggattcaggtccatagatctccacgatacgtcccttcggcactccaccgactccaagcgcaatatccagtccaagagagcctgtcggaaccgcttctactaccatattagaactggaatccccaagcttcattacagatcctttaccgtactgcttctcaatatgtccaagagctgcctccagcgctttctgcttctcttcattaatcatcttatggattctccttatattttcttaatttcaaacgctcatgccaaacctatgttcgtgttttcttcttatatgctattataaatcgtcggcaaagtcaagcaaaacttttcgacaaaaagggcaccgtttctgcacggtgccctgcatcatatttgggtttactccttatttatcaccgatcagccagttgtacatttcttcgtactgttttgcagaatgactccaggagaaatctgctgccatggcacgatcaaccatcttgttccactcgcgtttattatcgtaatatacacgttctgcattgcggactgttgcaagcatttcatgtgcattgtaattcgtaaagctgaatccggtacctgttccttcaaattcattgtacggctgcactgtatccttcaggccgcctgtctcacgcacgatcggaagtgttccataacggagactcatcagctggctgagcccgcatggttcaaacagagacggcatcaggaatgcatccgatgctgcgtagattctgtgtgaaagcggctcatcataataaatctgtgccgatacttttccatgatatttccagtcaaaatgacggaacatattctcatagcgctcttctcctgttccaagcactacgatctgtacagcgtcctgacagagttcatccattacatatgcgatcaggtcaaagcctttctgatctgtcagacgggaaacgattccgatcagcatcgcattcgggtcttcattcagtccaagatctttctgaagctggatcttattcttaactttttccttacggaaagtctttgcattgtagtttctggtaatacatttatctgtttcaggattgaatacatcataatcaattccattgacaatacctcgaagatcatgtgctctggcacagagaagaccatccagacgttctccatagaacggagtcttgatttcttccgcataagtattacttaccgtagttactgcatcagcaaaaacaattccacctttcaggaagtttgcatctttgtatgcttccagtttatccggtgcaaaataataatcagaaagtcctgtgattccctgaacagtctttacatcccatactccctggaatttcagattgtgaattgtcataactgtcttgattccccagaaaaattcattttgctggaaggaatcatgcagatataccggaacaagacctgtctgccagtcgtgacagtggatcacatccgggcggaaaccgataaccggaaggacagacaatacagcctttgagaagaatgcaaatttttcaagatcccatggggcactgtcatatggcttcggtccactgaaataatattcattatcgataaaataaaactggattccttcgtattccatatgcataatgccaacatagcagtttttgtatcccagatccatataaaaatgagtaatgtattccattttatctttccattcctgtttcatacaggcatatttcggcaagataacacggacatcaaaatagcgcttatcaaaacatttcggaagtgcaccagctacatcggcaagtcctcctgttttaataaatggtaccgcttctgatgttgcaaataaaattcttttcatctgtaaatacccctccttgtatctcgatgccagattattgttatttcgaacatccgctcgttattttctgacatttccgtctgtgacagaccttttgtttattatactccaaaaccaccttgttgaaaagagtgatttttgtattcaaggcgaattttatctgcaataagtgcaataaattcagagttggtcggtttgccttttcctgtgctgaccgtgtacccaaacagtgcatcgatcgtatccatcttgcctctgctccatgcaacttcgatcgcatgacggatagccctctccacccggctcggagtagtctgatgtttttttgcaattgtcggataaagtacttttgtgatcgaattcaacatttccatatcgttaacagacagaatgatcgcatctctcagatactgatagccttttatgtgtgccggaacaccaatttcatgtataatattcgtcacatctgtttccagattccgttttccgtaaggcgccggttcctctctcaccgcctgtcgcaccggttctctcatttttcgttcatttcccctgcgtatatgtttgatacgacttaagagcacctgtttgtcaaaaggtttcagcatataataatatgcgccaagattgaacgcatcttctgtgattctttcctgtcccaccgccgatactacaataaaagccggctgtttctttactgaactgtcatgactgcagtgttccataacggtaagtccatccatcttcggcataatgatatccaatacaacaacatccggttctttttctctgatgatgctgcagatttcttctccattgtgtgcttttccgaccaaagtcaggtctttatcttcttcgatcatctgaccgagtatgtcagccattctaacgttatcatctgcaatcgccacatttaatttttccatgaggcctttccctcctaaccaacaaaaatcttcttccttacaacaaggacattatagtggaaaggccttcgcgaaatcaagccgaaactggctgaaatacggcattttcgttcggcctgaatcgactttttcagatattttccagcatgttttctgcaaaaataccatatcctcctgtagaatcctgtataaaaacatgcgtgacagctcccacgaattttccattctgaatcaccgggcttccactcattccctgtacaattcctcctgtcagttccagaagttcgggatctgtcacctgaattacaaaacttttatttgtatcttcatgattcatgtcaattcttgttatctcagcatcgaattcacgtaccgttccatccacacagcacaatatggatgccggcccgatttccagttcctgtttgtatgcaacttccatctttcgcaatccaagctcctccggcagttctgataattttccataaattccctgttcacagtttttttctatacttccgattattttttccgcctcataatgaatcagaccggaaagttcacccggacttccgctgcttcctttctggattccaacgatctgtgcctgatacaggtcaccatcatcaatatgaagaagctctccggtatctacatcgctgattccatgaccaagtgctccgtaatttccattctgatcaacaaatgtgagtgtcccgattccctgtgtattatctctcacccatatacccagcttatactcgcccttgatatcttttaccggactcagcgacagaggaatcttttttccttttcttattacctgcaactccacagtatcctgtttcagcttttcaagatcttctacaagatcttttttagtttcaataatttcatcattaaatgcaacgatataatctcccggctctataattttttctgccggttcctccgcacggccttcttcagaaataatctcaccggtatcaattaccagtactccgtcggtttccatatagattccgacagtgcttccactgacaagcactgtcgtactgtctgtggggattactttgacatctttaaacggtatcactcccaaaattctgctggataacagataacttccatctccggaaaccgtaattgcatcatcaaaagaaagcagcggataatccagtacattcttcacctgctgttcctgactttctgtcacataaagctcatcaggaatcttcctgtcaagatatcgatatcccagccatatcaccgtcagcagatccaggcatataatccaccagagaagatgtctgtattttgttcttctgtccattctgccacatcctttcttttgtaaaaccaaactctcttccaccagcatttttacagaaaaaaaagagaagcgatcctgttggatcatcctctcttattatgctgtgaatacagctatttcagtcttgtatttttatgaacccgtgccaattctttcatttcttttgcgttttcaaaaactgcctgtgtaagttcagctccacccagaagtctggcaagttctctcacagaatcatttccttccagcggatgaatctccgtgatcgtttctgtacccttctgatgtttttcgatttcaaaatgtgtatctgccattgcagcaatctgcggaagatgcgtaatacacaatacctggtgacattttccgataactgccattttttcggatactttctgcgctgtcctgccactgatacctgtgtcgatctcatcaaagatcaatgtctctatctgatctctgtctgcaagaattgcttttattgcaagcatgatcctggaaagttcaccgccagatacaatcctgcctaatggttttacgctctcacccggattggtagaaatttcatattctatatcatcaaacccattatctgtatattctttttttcgttgaaaatcaatatgaaactgtacgtccagaaaattcagatctttcaatccctcaataatcttatccgtaagcatctggctgtattttttccggataacagaaagtttatccgaaacaatttcaagctgtgctctgcttttttctacttcagcttttgctctccggaaattctcctcatatctgtcaagatcttccagtttttgtttctggttgccgcagtatgtgtggattgcctcgattgactgtccatactttgctttgagattgttgatcagatccaatcttctttctgtttcataaaatgtttctccgtcaaagttcagttcatccacataagaggaaagctctctgttgaaatcattcaaaagcccatcgatttcctgaagtgctgatgacatggatttcagctggctgtcatactccgtgacacgcatcagctctttcactgcatttccaaccgcttctccggctccctgcacggaatcatttcctgtcagatcccgcacctcctgcagagtctcaagaatcttcttcccgttatccagcttacggtacagcttttccagttcttcatcctctcccggattcaaattcgcgctttcaatttctttaatctcaaattccagaaaagcacgctctctgtttctctgttcttcatccatatcaagagactttaacttttttaggctgtcacgatatgtacgatatgcacgattcactttttctttgaccggatagatttcatctttaccatatgcatccagaatctccagctgtttatcctgataaagcagagactggtgctcatgctgctcgtgtatatccagaaggcaggaagctactgctttcatctgtccaaccgtgcaggtctccccattaatcttgttgatactcctgccatccagaattttacgtgtcagcaatacctgtccttcttccagctcaatccccagtttgcccagtgcttcttcagctcttggattttctacctgaaacaacagctccaccagtgcatataacgcaccttcgcggatcatatcctttgcaattctgctgcccaggatcagctgcatggaacccagcagaatcgatttacctgctcctgtctcaccagtcagaatattcagtcccggcccaaattctacttcaatatcttcaataagtgccagattcttcacatgaagatgaactaacataatttcagaattcctttcagcttctcagcaacaatttctgcctgctctgcatcacgtgccacacacatgactgtatcatctccggcaatacttccaagaatctccttccatttcagggcatccaacgcagccgccacccccatggccattcccggcacagtgcggatcacaagcatattctgacctacatcaagtgatgtcagtgtatcctggagaatccttgtgtatttgtctcccagttccgcagacggttctgtaagaatcgcgtaacgggattttccatcctttcctgcaactttcataagcttcagtgcccggatatctctggagactgtagcctgtgttactttgaatcctgcctcattcagtctggcagcaagttcctcctgtgtatcaatatcatattcctgaatcagttctatgatcttttcatgtcttgcacttttcactgcattacctccatcacattgtcactgttattccatcttctgccgtaatacctctacaaagcttaaatgatttaatttcagaattttcacactggctgaagctttttgaatcacgatcctgtctcccgtcacgatcggaatttctgtatctccgtcaaaagaagcaagcccctgttcctgaacctgcctgcggccttcccccagctctactgtaataacatcttcctccggaaaaataatactgcgggtattcaatgtatgcggagcgatcggtgtcatcagcgtcatcgccgcatttggagatacaataggtcctccacatgaaaggctgtaaccggtagaacctgtcggtgtggcaataataattccatctgcattatacgaattaagatagacatcattcacataatttttaaatcttacaactcgaagggggccctctctgcctattacaatatcattcagtgcaatgtcctgcccaatgatcttatcaccatgccagactgttcctgtaagcatcattctttcttcaatctcatagtcatctgcgatcagtttatccagtgcagcatgtatcgactgtctgtctacttcagccagaaaccccagcgtcccgagattgattcccagcattggaatttttctgtaaacaacatctctggcagcctgaagaagtgtaccatcaccgcccagaaccagaatacactgtgttccctctggaatcagttccggatttgtataatggtatgccccttccaacttacgttccgcctgctgaacctgacatttctttccattttttttcagataagaaacaatttcatttgtgatctgaaaatctttatctttatcactgtttgtgatgatataaaacttatccatctcccctagaccttccttaatccagttgactgtgtgcctcctgcactacagcctcaggtgttacttcaagagaggactggatcacttccccttccggtctctttttcaaatgaagcaagtattcaatatttccctctggtcccttgatcggtgaaaacgaaagatggcacggctccattgcaattgtagacgcataagcgatcactttttcaatgacttccaggtgcactgccggatcacgtacaacgccttttttcccaactttttctcttccggcttcaaactgcggtttgatcagacagacgatctctccatcatctgtaaggaggtttctcactggaagaagcacttttgtcagagaaatgaaagaaacatctatcgatgaaaactgtgccggctcctgcagattttccggaagtacataacggatattcgttttttccatacataccactctcggatcattacgaagtttccagtcaagctgtccatatccgacatcgattgaatagaccttcaccgcaccattctggagcatacagtctgtaaatccgccagtggacgcaccaacatccatacatacctttccatccagagaaacgccaaaattattcatggctttttccagtttcagtcctccacggcttacatatggaagtgtatttccgcgtacttcaatcttcaccgtctccttgaacattgttcccgctttatcttctttctgtccgtccacataaacatctccggacataatatatgcttttgctttctctctggaaggtgcaagtgcacgctctaccatcaaaagatccagtcttttcttcattcctgctcctcatattcctcaatcgcatcaagaatatccggtgctgaaagcccgattttggctctcagactggcaatttctccatgctctacaaaacgattccagatagcgatcggaagtactcttacttccggatgacatgcttccatataagctgccacatgctcaccaaatccaccgtttctgacattttcttctactgttacaaataatttatgatcttttgcaagctcatcaagaagctctgtatccagtggcttcacaaatcttgcatttacaaatgttggattttcacctttgttcttcagttctttgcagacctgttcacagacctccgtcatgcttccaacagacagaagtgctgttttctctccacggtaaagaacttcactttttccaaaacgtatcgggctgtcaaattcctccagtccctgatatgcagtgcctttgggataacggattgcacatggtcctgccgcatgaactgcaaattccagcattttttcaagttctcttccattttttggtgccatgaccgtcatattgggcatcattgtcagataagacaagtcaaaatttccctgatgtgtctctccatctgctcctacaagacctgccctgtcaatcgcaaagatcacgtgcaacttctgcatgcagacatcatgaagcatctggtctactgccctctgtaagaaagaagaataaatcgctacgactggtatcacgccacccagggcaaggcctgctgcaaaactgactgcatgctcttcggcaattccaacgtcaaataatctgtccggaaaagctttttcaaaagccttcagtccggttccctccttcattgccgctgtaatgccgacaagcttcggattttcttttcccagtttcaccatagcctgtgaaaatacatctgtatacgtcggtcctttcttcacagaaagctgtctgccggtttttatgtcaaacgggccagttccatggaactgatccggatgcagacttgccggttcatatcctctgcctttgtgcgtcaggacatgaacgatcactggtccttccacacgttttgcttcgttaaaaagtttcatcatctgccgcatattgtgtccgtcaaccggtccaagatacgtcagtcccatattttcaaaaagcattcccggtatgatcagctgtttgatactgctcttggtcctgcgcatggtatctacaaccgcagtacctaccttcggtaccttcttaagcgtcttagttacattcagtttcattcccgtgtaagcttccgctgtacgcaatgcactgagataagaagacattccaccaacatttttggaaatagacatattattatcattgagtacgataataaaattggttttcaattctgctgcattattcaatgcttcatatgccatgccacctgtcagtgcaccatctccgatcactgatacgacacgataattctgtccaagcagatctctggctcttacatagcccagccccgctgagattgaattagaactgtggcctgcatcaaatgtatcacagtcactttcacagcgtttcggaaatccactcattccgccttcttttcgaagatttttgaatccttcttttcttcctgtcagaatcttatgggtatatgcctgatgtcccacatcccatacgatcttatcctgtggaagatccagcacattatgcaaagccagtgtcagttccactaccccaagattcgatgccaaatggcctcctgtctggctgactgactcaatcaggaactgtctgatctcatctgcaagctgtggaaaatctgccaacgctatcttgtgtatatcattaggcttattgatcttttccaacatccttcgtatccctctttcatttcctgcgggttgccatttccatgaccagctccgtcaggaactcatttttattatacagtctgtccagaactgccagagctttttcagaaagttctctgacctgctcagatgctttctgtaccccaaaaagagtcacataagtaactttgttgtttttttcatcactgtgtaccggctttcccaattcctgactggtacttgtcacatccagaatatcatcctgtatctggaatgccagaccaatatccgatgcagcctgttcgatcatggaggtctgttcctcgtccgctcctgccagaacagctcctgccatcatggacgcttcgatcagtgcagaagttttgtgttcataaatgtaatcgagaaggtccttctccaatggtttgccatcattttccacatcaacactctgaccgcccagcataccgtaaatacctgttttttctgccataatccgcacagcccggatcaccctgtctttgtcatctgtcagttcaaatgcacgaaacatggtctcataagcataattcaaaagtgtcacaccgcttaatacgcccattgcctcaccatacactttgtgcgtagtcagacgaccacggcgataatcatcattatcaattgccggcagatcatcatgtatcagagaatgtgtatgaatcatttcgattcccgccataaacggttcagcaagtttctcatcccctccaaataatcgaagagtctccagaagaaggatcggcctcagtctcttgccgccggcacacatgctgtagttcatcgcctgtgccatcgttttggaaaatccacgttcttccggaagccatctgcggatcacttcttctgcataatctgttctctgctgtaattcttctttaaaattcacgtaatgtcccatcctcatccatctgaagcatcttcttttctacagtatccagtctgtcactgcagtatttcagaagctccataccttttttgtataaacgaaaagaatcctccagcgatgtgtcaccactctccagcttttcagcaatggtgtccagttcctgaaagacttcttctatttctctgttctgtgtatctgttttctgaatctgttctgtcatttattccagtcttccttcctgctgcttcgcacttctgcctcgatcacaccatctgtcacagaaatctccaacagatctccggaatgtacctgttttgtggatataattccatttccctctctgtccgaaacaaaagaatatccctgatttaatttatacaaaggagacagtcctctgtatcgttccagatagattccaagcatatgtctttcttctgcaatgcggtttttcattgctcttcgaagcaattcatcaagatcagccagacgctgtctgttatccctgagctttgcttccgggttcagatactgaaaacgcatctgatactgcatcagctgtgcacggccaagttctgccctgcgctgcattgccttctgcatacggtctctgaggccagcaatattctgcagtatctgtctgaaatccgccactgcaagttctgcagctgccgaaggcgttggggcacgaagatctgccacaaaatctgcgatcgtaaaatcagtttcgtgacctactgccgaaataatgggcgtcctgcactcaaaaatagctctggcaactttttcttcattaaatgcccagaggtcttcgatcgatccaccgcctcgtccgacaataatcacatcaacctctgcctgatccagcatatggattccacgtacaatactgtctgctgctccttctccctgtacaagtgccggatacaaaataatctgcagataaggatcacgtctcagtgaaatatttcttatatcctgcacggccgctcccgtaggcgcagtaacgactcccagcctgtggataaaagccggaattggctgtttgtactcctgtgcaaacattcccatctcttcaagctctgtcttcaacgccagaaatctctcataaagtgcacctgctccttcaagcgaaatttcttttgcatacagctgatatctgccatccctctcatatacatccacggcaccacctactacgacacggtcaccgtctttcattcgaaatgccagtcctcttctgtgtccggcaaacattacacaggaaagcactcctgtctcatctttcaatgaaaaataaatgtgtccactggtatgatatttgcagttggaaacttctccctttacatagatcttctgcagaataaaatcctgtgtaaacatattcttgacatatcgattgatctggcacactgaaaaaatatttttcatttttattattctgtgctttcttcagacgctctctcaggatttttctgatctttggaagcttttccatcctttttggatgaacgaatgataatctttgcagaatgagtctgacgacgtggtttcttatgttcctcaccggagtccttcttaccactggcgatttttccaagaataccattaacaaaagagccggagtcttccccgccaaaaagttttgccagttctactgcttcgttgatagcaactccaaccggtacttcttcatccattttcatttcataaacagccagacgcaatgcagtcaggtcaacacgattcattcgtgtagttttccatccacggctgtattcattcaggatctggtcgatctcatccagatgttccagaatatgctgatatttgttctgtattgcttcctgatctttttcttccagttctcctagtgtatcaaaatacatggaaacctgatctgacatttcattttcagaattaaactgtgtcataaacagcagtttaaaaatatgttctctctgttcgcttcttcgcatgtttcctcctaaagaaaaaaggaaaggtttactttccttttttctctcttccaatttcctttacttatcattctccatatcaacacctgcaatacggatgtttacatctgctacttccaggcctgtcatattctcaatggatgatttaactttgtcctgaactttcttactgacttccagaatattctttccaaattcaatattcagagtaagatccacggtaaccacaccttccagtacagtgatcttaacacccttggaaagattcttgacgccaagcttgcttaccagttcattggtgatatttccttccatggaagcgacaccctcaacttctgtggccgcaagtcctgcgataacagttactacttcatcagcaatcttaacttcaccaatcccacctacatcctgtaatttataagttgttcttttttctgccattccaattcctcctgcggatttcgaatcgaattttgttattgttcactccgttcacaataacgaatctgtcaattatttataggcttagtatatcaaatctgactgcaaaataaaagcgtttatttactgaattctgtcagtaccagatctggattacggtcttctgtcatgcctacgctccatgcgtttacaaacaaaagcagtggattgcccttcaggtctgtaaccttcttcatatcggaagttccgacaatcttggcaacatcaacttcttctttatttgcaatccagcggatatgctcatatggcaggttttccagacggatttctacattatattcattctcgagacgatatttcaacacatcaaactgaaggacaccaacaacaccgacaataatctcttccatacctgtattaaactcctggaagatctggattgcaccttcctgtgcaatctggttgattcccttaacaaactgtttacgcttcatggtatcgatctgacgaactcttgcaaaatgctccggtgcaaaagtcggaatcccttcaaatgcaaatttctttccaggtgcacagatcgtatctccgatagaaaaaatgcccggatcaaatactccgataatatctcctgcatatgcctcatctaccacatgacgggattctgccatcatctgctgtggctgaagaagacgcatcttcttatccccctgcacatggtaaacttcctgggaagcatcaaatttgccggaacagattctcataaatgcgattctgtctcgatgtgctttattcatatttgcctgaatcttaaatacaaatgccgagaaatcatcagacatcggatctatctcgccttcatcggatactctcggaagtggcgatgttgtcatcttgaggaaatgttccagaaatgtttccacaccaaagtttgtcagcgcagaaccaaaaaagacaggtgtcatatttcctttgcttacctgttcctgatcaaaatccacactcgctccatccagaagttcgatttcttccatcagctgttctctctgatccggatccacaatatcatccagccgtgcatcatcaatgtcaatttcttcgatcacaccctccttggttcctttctgtgtatcagagaaagtcaggactttatgtgtattacgatcataaactccgcggaattttttaccggaaccgatcggccagttgatcggacatgttgcgattccgagttctttttctatttcatccagaagatcaaacgtatcatttgcatctctgtccattttgttgataaaagtaaaaataggaatatgacgcataacgcagactttgaagagttttctggtctgtgcctctacacccttgcttccatcaataaccataacagctgaatcagcagccatcagtgtacggtaagtatcttcagagaaatcctgatgtcccggagtatccaggatattgatacaatagccatcataatggaactgcagtacagatgaagttacagaaatacctctctctttctctatttccatccagtcagacactgcatggcgggatgtagctttacccttaacacttcctgccagattaatggcgcctccatacagcaggaatttctctgtcagagttgtcttacctgcatccgggtgggagataatggcaaaggttcttcttttttctatttctttcgcatacttagacacgtttttcctcctgtctattatctgttttctcaattatccaatttctatacaactttttattctagtatatcaaataccctgatgtcaagaaaaaaagggaagaactgcccggctcaaaagtccggacagttaccctgcaggatacggtctgcaaataaccatacagacgcattttaatcatagattccttccgtaacaatatcttctcctgaagtttcctgctccttgtatgtatcagtctgttgctcatctgtcttctcttcgccatcactttccgaggtcgtatctgttgccgcttcatcattgccttcatttaatggcgtgatcacaatattttccggtgtgattcctgtctttctttttacaatatcttcaatctgtgcacgctgtgcatcttccagctcagcctccggaacaaccacatctgcagtctcacccgtcagattgacaattgcattttcaaatcctttcgcctccagaagcatttctgcggcagcttccttttcggatatttcagtcatctgcaccatcgtatttactgcttcctgtttctgctcatctccaacctctgtattgttcaggatctcctgcagatccgctttactctgagagcgaacctgttctcttgataattttgcctgtgctgcaaaatccgatgctcctgtaaggaccgcttctcccggcgtactgcttccatctggtacttccgcagtctccgcagcagtctctgcattttcatctgctaccgctgtttcatcactcagatcatactctacctggtccaggatactgctattgtccgtgcttgcctctttatcaccaattcccaaatctacatctgcaaagttcaaatacccggctacggcgatcagaattgcaagagatgtgatgatcacctgattttttttgaatatttttttcacgtcttaactcctcatttcattttcattattctaattttatgagcatctatctgaaataatgccattactgcctcctgtattttccggaccgtcacagaattatctgctccttctgcaacgatcagcactccggtaacttcatttcccccagaaccatacagcccctgcccgctctctgtcatcagcattactttcacatttcctaccccttcaacatttttcaaaagatcttccagtttcatctcaagatctgtcttggtttccatattttcacctgtcgtcgttgaaaaattctgattttctgtttcagtctctgttttcgatatgggaaatgcaattaccatcagtaaaaggcccagaagcagaatcaccagccaatgttgtctgttcatctttccccataagaagctgacagtttttctcttcgattccgaagtccctggcaagtccatcccgaattcccctttcctgctcctgtgtaatgtttcccgctgtactgatcaccgccgtaatctgatctccatttatatgtacgacgatatcctctgtttctattccattttccttacattttttcgaaatttctttttgcagctccctgctgtaattctcctgcaggtaaagtgcctgaagattttctgtatttttttcttccagtgctgtcagttcttcctgataatttaatcgaaattcctgcagcagtttttccccatttccaaacaggttaaaaacaggtgtgcttaaaatatagatcagaaggattcccatgaaagaacgaatataacgttcatattttacatccggcaccagatggagcactgccgaaaagacaatatagaaaaaagcaatcgtttttacccatcgataaatttcctctttcatccgcttcctccaatcccggtcatcaaaataacaaaatcaaggatacataaaatctctgccgtaaaaagaatacgcaggagcagcgcacagccttctcccatcgttgcaagtgaatctacgatccttttttccgagactggctgcgctattgctgccagaaatcgatagagcagggacaaaattccataatggatcaccggaccggcccctgctgccacaaaagcaaacagtataacaactccaaggcagtttctcacaagtaccgcacttgtcagtaccagctctgtaaccatattcactgcattccccactcctggcagcgcacctgctgcctttcccagtgcacttctttttaaagtatccattaccggagcaataagtcctctcacaacctgcagtcccactaccataccaagaagtgttttcaatccccaactcactgcagtgtccagaagttccgccatttttccaagcatttcctcttttgacagattgttgatcagcgagatcagcacatacaggcatgctcccggaaacagaagattcaatattacttcctggatcagccaggtaaggatcagaaccccctcataaaagaccgctgccgtcgaactccctgccgctatcgatatagtcaggaaatatgccggggcaagtcctctcataaactccgccatccatgtaatcgtctgctgcacggacctggtaacagatgaaaaagaagccatcagcagaataaacagcaacaaatagacaatataaaaacagatatctccaatctgtccgctctcaaaaacatctgcaaaattcgccagtacagcagatagtaaaataagaagcagtatttttatcagaagactcttttccttttccagaccggaaaataaaaaactgtgcaccatctcctgcacagtatcttcagataataccttttctccttttatcagaccatccagcatgtccttcatggaaaagctttcttctccgagcatctggtccagcatcctttgcacccgtgaaagatcaagttcttcaaggatatccgataccgtactggcttccgtctgcgttatcttttctttctctgtccctcctgaattattttcagtctctgtattctctgattgcctttcagctgcctgacagataatacttcccgatatcagatttgaatttttcagatccgccagattcatcagtaatacgagcattcctatcataactggtgcatatttttttccacgccatcttctgctctgttttcggcgcttcatcccagaaactcctgaatcgtttccagcaatgccatcaatacgggaatactcagaaccatgacagataatttacaaaaaagttcaatctgtgacgcggttgcctgatatcctgcatctttacagatcccggcagaaaactgcccaatatatgtaattcctatcattttaatcagcgtaagaaaatactccggatccaccgacagactctgctgtatttttccgatcatccggaaaagataatccagtttatccacagccagtcccagaattatgatacctatccccatcgttataaacgaaacatattccgttcttgttcctttcaaaaaaaagccaagcactacaccgcagattcccagcagagatattctgataatatccacgttttctgctcctttcagattacaaataacttctggatgttctgaaacaattcataaatatacggaacgatccaaaacagaacgatcaacaaacccgcaaggcttaccataaaagcctgctcatccctgccactgtgtttcaatacctgagaaagaatggaaacaagtatcccaactgccgcaatcttaaatatgatcgtaacttccattctctctcctttctccggaattaccagaataatattgcaagcaggatgccacccataacaccaagacttcgatatatttttttcttttcctctttatctttccgcagattttgtaaaagataaagaaaatctgtttcatatagttccagctgccgaatctgcatttcccggtccagatagccaagtttctctcctagcaaacttatttttctccgttcatcctcatcgagttttaaatctgtaaggtaattttctgtacaattttgaaaaattatgctgagtttctcttctgtgttagcttctatgcatgcagccaccctttctaaaaactcctcgtaccttccccgacatctacatgccgtatcgcgaagcgcatccgaaagagagctgtttccgcaccgtatctctcctttcaggcataaaataacctgtaaaaactcttcaagatttttctcatgcagcataagttctctgctttttaagtatcccagtcctgcggacgcgaagataataaggacagctcccaccagtttcagcatggttttcccttcccatcatatattgcttctatacttcctgcatgtcctttttttccaagaacgatatagcgttcaaagacttccagttctctcagtttctgaaaaaagggctgtcttaaaatatcttccagtgaatttccgtgagctgtcgcaaacaatttacacccacaatggaccacggactctaccgctttaaaatcttctttcttcccaagttcatctacagccacaacatccggtgacatcgaacgcagcaacatctgcattccttttgcctttgggcaggcatccagcacatctgtccgcatccccagatcattctgtggtattccctgatagcatccggcaagttcacttctctcgtccaccactcctactgtctttccctggattctatctgtcccattgctgatctgccgtatcatatctctgagaagggtggtttttccacatcttggcggtgcaatgatcagtgtatgatatacctgctctccatttcggatatacggcaacacttcatctgcgcacccctgtacctgatgtgcaagccgcacgttgatgcaggaaatatacttcatcccccggatatgttccccatccagaatgacttttccggtaattcctacccgatgccctccctgtacactcagatagccctgacatatttcatcttcataagcataaagagaatatccactgatatactccagtgtttctttcagatcctgtctcgttacccgataaggcattccatttccggttcggagaaatttttctccgtctccataacacagaaataccggtcggcctgtccgaagtctgatttcataaagtttttcgtaatctatcacacattcttccagaagtttccggatatttccggcaaaaagactctgaatctgtcccgccctgatcgtcctcacctcttttactactgcgaacgactgtatctcttttacactaatatatgtccaatgtccggatttagtacaaaaagaatcccgcagctttcgccacgggattctgtatcactccaatattttagccacaatatttcatggcagctgtacttccgcatgctcccatcgcagttccaatggtttacgcgaccacacagcgccactatagtcttctccgagttccagcatcaggtaaattccatcatccatggaaatcgttcgaagatctcgggacaggccttctcccgtccatttaatataggcttcccttaatacccactgcgtaaaaaaggctttttccggttcatcactgtccagtatttctcgaatcatatccgccggaaccattctctccagcatccgttcataatttacctttttatgcacctgcacatctattccaatttcctggtctgcgatgatacacattacatattttccggaatgtgtaatattataatgtatcttcggctgcagggtaaggaatggtttgccatgttcaccggtagccctcggttcaaatgccagcttcagtccatactctttgtagagtcccgtcgcaagcagtttctcccctatcatgtgctccatatttttgtgttcgtactgctgtggaacttctgtaaaataaataaccgccttcatactccagcctcctttaagaatcgggacggttcccgtttcttctcatactgttgtctcacgtaacataaagccaactgtttcctggcccgtgtcattccgacataaaacagtctgcgttcttcttcaatggcaggttccagtaccgcttttcgataaggcatactaccttcattaacattcaggatatacacctgttcatactccagacctttcaccccatgaagtgtagagatcagaacgccctcccgttcctgctcagcttttcgtgcctgctcttcaagcttttctgtgtattcttctatgtaggattcccattcttccagactgttcattccttttgtactttctgtcagccggtccagaatctcactcagctcttctggttttattttacgatactctgcatattcacgcaagtattcttcatatcccattccctttcggataaaattaattgcagcataaggtgccagactcttcagcactcgcaaatgcgtttccaatgttgtgatacggtcacacatccagtccttatctttataaaattcttttagttcttcaaaggatacaactgatgataatgacaaggcatcacgggaaatatatcgattgggccgattcataaattcaaggaaatacttcctgttcttttcccctgctgcaaaatgcatataggcaagaagattccggcagatccaatgctgaaaaagattcgggagtttttccttcatgttaaacgggacctgtcgttccatcaatgcacctaccagtccttctgcctcctgattcgttcgaagaagaattgccgtatcttccagacgctctccgttttccatccgttctctgagttccgagacaactgcaagatattcttctctcggattttggaattcccgtatctgaaccgctttacctacctgattcggtgtggaaagctttttggaaaaacgttttttattttctccgatcacgtgcatcgctgctgaaaggatctgtccactgcatcgataattcacatccagtgtaactgtttccgcatccggataatctctggtaaaattcagcataatttcaggccttgcaccacgaaaatgataaatcgactgatcgtcatctccaacgataaacaaattattctgtggctttgccagcatgcgtacaatatcatactgcaattggttgatatcctgaaattcatccacaagaatatactgaaatttcttctgccatgcttccagaatatcttttcgctgcacaaaaagctcataacaatacaggatcatatcatcaaaatccagtttacgtctgctctgacaggcttcacggtatccctggtaaatctgtcggaacacttcatccggacagcatgaagaatagtaatgttccagtgcaattttgtttcctttcaccacactgatctccctggcaatctcttccggaaaatctccttcttctgccagatcaccaccataattcaacgtcagttctctcaaaatgccgaatttttcttcatcagacagaatattagccgcagtaaatccatatgcctgtttcaatattccataaaacacgccatgaaatgtaccaaaagtaaccggagtatactgctgtccggtaaaacttaaaaagcgctccttcatttcctttgccgccgccctggaaaaagtcacgaccagaatattagaaggtgagattccgccttcatttatcatatatgcagttcgttctacaattacggaagttttccccgaaccggggcctgccagaaccatcattggtcctgacaggtgggcgatcgccctttgttgagatggatttctttttatcatttattactctcagctgagtttctcaattgctgcctttacacgtttcagtgtttcttctttgccgatgatttccataatttctgttgctccggccggtgtcatctgtttaccggatactgctgtacgaagcggccacattacataaccgttcttataacctttttctttgacaaatgcacttaaagaagcaaacagtggatcatttgtataatcttcctgtgcttccagaaccggaagaacttctttcaatactgcaagagaagtttcttcatttgtcttcatcttcttgtggcagtacattgcagaatcatattccggaacttcttcaaagaaatcgatcagtgccgggatatccgggaatgtctcgattctggtctgtaccattccggcaattttacggaaatcataatctcttttaagaacttccttcatatatggaagagctttttcatagaactcttccggatccattttcttaatatactcgccattcatccagcgaagcttggtaatatcgaatacggccggtgatttgctgatatgatgataatcaaaagcttcgaccagttccggaagtgagaagatctcacgattgtcctgcgggctccatccaagaagtgcgacaaagttaacgattgcctctgtaacaaatccctgattcagaaggtcttcatatgaagaatgtccggaacgtttggaaagtttctgatgttcttcatttgtgatcagcggacaatgaacgtataccggaatctcccatccgaatgcttcgtagatacggttgtattttggtgcagaagaaagatactcatttcctctgacaacatgagtgattcccataagatggtcatcaattacgtttgcaaagttgtatgtcggatatccatcagatttgatcaggataaggtcttccatctcttcgttgttaactgtgatatctccatagatcacatcatggaatgtcgtagttccttctgtcggcatattaaagcggataacgtgtggttctcctgcatcaagacgtctctgtacttcttcttttgacagacgcagacatctcttatcgtagatagagatttcttttcctgcaactacacgtttcatagattccagttcttccggtccacaaaagcagtaataagcatctccctgctcgatcagctgctgtgcatatttcagataaagtcccgaagcctgtctctcactctgtacatatggtccatatcccttatctttgtccggaccttcatcatgaatgagtcctgttcctgccatcgtacgatagatgatatctacagcaccttccacataacgctcctggtcagtgtcttcgattcgaagaataaaatctccaccttcgtgttttgcaatgagatatgcataaagcgctgtacgaagattacctacatgcattcttcctgtagggctcggtgcaaatcttgttctgatctttgtcattgtatctttcctgcctttcaaaatatataaactcagaaaaaacccctgagacatcactgcctcagggaatgttctgcatactaagcttcgatgcctctgcctttcagatattcgatcacatctcccactgttgccagttccgtcagctcttcagcaggaatctctatattgtattcatcttccagagccattaccagttcaaaaagatcaagagaatctgctccaagatcatctttaaaagaagtatctgctgtaatttcgctttcttcgcagtttaactgttctgcaatcatttttctcatttcttctaacattgctatttctcctttatcaagtaacaattttgctctactttgatgtgcaaagtatatattctgagaacctatttgtcaatagattttgcttattttagagaagcctttccggctctttaaatttaatctgtctggccacactcaatgccagtcccatctctgccatcaggaacaggattgatgtacctccataactgataaacggcaaagtaacacctgtatttggcatcagatttaccactacggcaatattaaaaataacctgcagtgcaatatgaataaaaataccgctcactatcaatgagccaaacagatctgatgcattctgtgcaataaagaacaatcggtacaaaaggtaagcaaacagaagaagtacgatcattccgccaagaattccaagttcttcacatacaatagaaaagatcatatcgttctgcgcttccggcacacttccgagcttctggatactgtttccaagtcctcttcccagaaaccctcctgatccaatcgcatacaatgcctgtatcgtctgatagccatctcctgatgcataatcctccggatgcagccatacaaggattcgtctcaaacggaaacttgaactggtttccatcgttgcacttaagaagctgatagcaacaatagcaacaaccagaagaatacctgctgcaatgaggaatggtcttacttttggatgtgcaataaagataaggccaatcgtaataccgaaaataatgatcgcagtactcaggttatctgtaaatacatatgttatgaatgcaagcgcaccgccacttcctgccagcatcataaagcctttcagtgtaccaatctttcttcccatatttacgatcatataagaaagacagacgatcactgcaatcttcgcgagctccgacggctgaaatgacaatggtcccagattcagccatcgacgcgctccatttgcgcttcgtccaagaggtgtcttgaccagcagcatcagcactgctgctacaccataaataacccctgtaaatctcgtcaatatatgataatctatctgtgagattgcaagtgcggctatgatacatgccagactaatcgcagcctgttttttaaaataatacatatcatcgccatagttcagttctgccatgtaagagctggtactgtacagcataaccagtccaaaacaagtcaaaagaatgataaccgcgagaagactgtaatcataataatcggttttcttttttatttttggttttcttacaactgctttttttctactcatagcatacagtatagcagactcctttcccgtccgcaagaaaaaaacagggaaacggcatacaatccatttccctgtttttatcatgattttttatttgtcactgtcatcatcgattgctgctgtttcaataacaaattttacgtttccgctcatatcatcttcttttccactgaaggaatgatatgcattgtcatcagagcagatcgcatccagacgatccaggatatcctgcagatcatcatctacaagatctgaaagtttctggattccctcttcatcaaattcttttgttccgtcagagagtttctttgctccatctgcaaggctcttaattccactcttaacctgtgcacttccgctgctgagtgtagatgttccgctcataagctgctgtgtaccggatgcaagctggcttgctccactgttgagtttgctgctgtttgcagaaagtgtgtttgctccactggtaagctgacttgttgcactggtgatctttgatgttccactgttaagctgtttgcttgcacttgtcagtttacttgctccgctggtcagagtctttcctgaactttcaagagctgttgctccacttgtaagctgtttattagatgctgtcagtgtatttgttcctgcgagcagactgctggttccttcatcaaccttatcataaccagcctgaagctgctggattccatctacaagcttatctacaccctctttcagagtattcagcattccaccatctaatttttctccaagatatgtctgaagagtagtctgaagtttctgaataccagcttctactgcatctgcgccctgtgtcagagacatatcttcttctgtcgtgccggttcctgtacctgcagctatcagtgcatttgcacctactgtcagtgcatcattgttttttgtaagctctgtaagtgcatcgtcgataccttttgtaagtgctttgatcgttgcctgtgtctgtgcatccttctttgcatcttctgcactctgattattcagagcagccagaccactttcaatctgagcaagaccttcctgaagctgtgctgctgcatcccctgccgctgcagcctgtgcattctggttacttacttcaccggctgcggactgtatctgagctgctgcatcattcagtccggacacctggcctgcatgtgcctgcaggtttgcgacaccgccctgtgccgttgcaacaccaccggaaattgctccgatcgcgccctgtaccgcactgttgactgcggctgctgttgcttcgtccatagaagaagtatcaataccgctgaggatatcgattgctgaacttgcactgtcaagtcctgcagagatcgtacctgcatctccctgcagtgcatccccggttccagctgcagcgctgacggttccggctgcggcattcagctgatccgctgcagaagtgccagatacagctccgacagatgctgctgcggactgtgcttctgcaagaccactctcaatctgggatgttccatctgcggaaccacctgtggaagacggatttaccagactgtttaatgtatctgcatttttctttatctctccgacagatgtcacatatgtgataaccttacccgcaaattcacctgttttcgcagcataagcctttgcactctctgcaaatttcacaatgcttgcaatagaggtctggagctccggaagttttgctttgattccacttacaagtccgttcacagatgtctgaagatctgtcagcccagctgcttcctgatcgatacctgcgcctaactgactcacacctgctgtgtaagtttcaattccgcttccaagatttgaaactcctgcaacatatttcttaactccatctgtgaggttgttgctgccttttacatactgctgtacaccggaagccaggctggtcacacctgtgttatattcttttaaggattttgataatgtgccaactccatctgcatattcattaacaccagaagctagcttatctgcacctgatgtataggaagaaacaccgctgctcagtgttgctgctccactgttcagtgtgctcacaccacttgtcagcgtggcaataccagaatcaaattcctgatatttttcatccagtgtagaagctccgtcagaaagctctttacttccatctaccagctctgttgctgcatccgtcagttctttcatggaatctttcagatcatccagtccatcgatatcatctacatccagagaatccagaatatctgttaatgcaaaagtgaatgtagaactcattgtaaagtctgttacatctgcttccattgtaaattcttccgggatatccagatcgatatcttcgtctacactgttcagatccagattgtctgccagtcccggcataccaacaccgattacaatatttctctggccatcagaaagaacttttccattatcaatcgtaacatttgtaaaattatctgtagggaggatcattgctgttgccattacaaatggcgcatacatctcagttgttttctttcctacttttgttttgttctttacgttatttttataagttacttcaattttcagatgaccacttttaccggcaagatcacttggacttatctgtgcaccgtccaggtaatatttcagttccatggaaaccggaagatctttggttgttgttccctgataataaatatctttgtcttctgtattccaggtcagtttatctccatcctgagagaaagtctcatcgcctttgacattcttgatatctttcagatcagatacatcacttaagtctcctgctgatgcagaattcttcagccagtcggaaactgtgatctcctgtggtgttccgtctgctgccgcatttacatatacggtttcttctttggaaatatctgtattcgctgccagaaccgggctgacacccatcaccattgtcattcctactgccacagaagctgctactgctttttttctgtttctgttcatgttctacgactccttttccagccattggcctgattcatatttatatagttatcttatatttttatttcttgtctggtaaaaatccctttgatgtgtgaacgataagcgggtcaaataccataaacatcgcaggtaatatcagcagtacaactacagtactgatcacggcaccacgggcaagcaatgtacagatcgcaccgatcatatctacctttgagtacagggctacaccaaatgttgccgcaaagaaactacatccacttacgataatagatttcattgagaatttatgtgcaatggaaatagattcttttttagtttttccaagatgacgctgtttctgatagttacttgtcatcaggatcgcatagtctacggttgcacccagctggatggcaccgattacgatacttgcaacaaatggaagcgttaccccctggtaatacgggattgccatattaacaaaaattgcaaattcgataacaaacagcagaataaatggtaacgagattgatttgaatacaaacaggatgatcaggaatattgctgccatagagaggatatttactctctggaggtcaacatttgttgtatcctgaaggtctttcatcagaggtgcttcaccgatcaccattgattcaggactgtatttcttaacaatcttctgaatcgcatcaagctgtgcgttgcattcatccgttgctgaagaatactctgagcagataaactgtacttcatagttatcggactgaagcatttttttaatattggaaggaatcatggattccgggaatgtaggtccgatcagggaattcattccaagtgaccatttcaccccgtcaactttgtcaatctgatccagcatctgtgttttttctttactgtccagtccatttttcaaaagtatcatatgaaccgtactcatatcgaagtcttctttcagtttttcgttggatacattactgtccagtgtagccggaagtgacttatcaatattgtagtaaatctgagtatgattgtttccgtaaacagccggatacagcattaccaggaaaacaagaagccatactttgtaatgctttgtgataaaaccagaagccttatccaagcttttgaccagtggtttatgttttgttttttcaatcactccgtcaaatacaaggatcattgccggcagtgtggtaatacagcagataacaccgatgacaacaccttttgccataacaatacccatatcacgtccaagtgcaaacgtcataacacacagagcaaggaatccggcaatcgtagtaaccgagcttccagctacagatttaaatgtatctgcaatcgcatgtgccatcgcacggtctttgctatcgtattttttcttatatgcttcaaaggagttcagaaggaaaatggaatagtccattgttacacctagctgaagtactgctgtcagagattttgttatataacaaacttctccaaagaaaatattagttccaagattgtaaacaactgcaaggcctacactgagaatgaacaacacaggaattaccagtgaatccattgcaagaagcagaaccagcaatgataagcaggctgcgatcacaacatagatcggcatctcttcaagtgccaggttcttgatatctgttacaacaccggacataccactgataaagcactgttcgtttgcgatcttacgcatgtcgctgactgcttccatcgctgcatcagatgatgttgtattatcaaacagtgcaatcatcatggtagcatcatcattaaagaatccatccttaaacttttccggaatcatgcttaccggaatacttaaatcagccacactgtcataccacagaacgtcttttacatgctccacattctggaatttttcttttaatgctgcgacatctttcaattccatatcttccacgactaccatggagaatgcacccattccaaattcatccaccatgatatcctggccttcaactgtttccagtgattccggcagataactcaggatatcgtaatttactctcgtcgctgccattcccaggaatgacgggataagcagtaacatactgatgattacaatgatcactttatgctttgctatccactttccaaacttaatcatcatgtcctccttattgaatatatttttcattaatgactatcagtcactttttattcatctagagttatatacccaaactgaccattagtcaatatacgtttttgccaatgtgtccaaaaatcaacaacttctttttgtgatattgacttttggtcatttctgtttataataaatggcgaaaccatcaaatacagggaggttttcttaatgggtaaattagaatcaaataaaaagaaaaaagaagacgcactgtataacactgctttcgaactgtttacaacaaaaggaaccaataaaactacgatctctgatattgttgagaaagccggagttgccaagggaactttttatctgtatttcaaagataaatatgatatccgaaacaaactggcctcttccaaaacgcaggatttatttttcgctgcatatctggctgttcgtcagaatcagatcacaggttttcctgctcagctccattttatgatcgatcatatcctaaatgcactcaaaaatgattctcagcttcttatctttgtttcgaaaaacctctcctggaatgtatttcaagctgcattggaacaaaaaatgcctgacagagatgtcagattttatgataaatatctccaactgatcgaggaaggtcatcaggcttatgaacatcctgatctgctgctcttctcagtgatcgagcttgcaagttcaacctgctacaactgtattctgtatcagcagccagttccacttgaagaatacatgccttatctgcacaaatccattgatgggatactttccagttatcagaaagattcttctgatacttccgcagactaaaacagagctgtaccttattggtcagctctgtcttatatttcatatctattctgtttttaattttccatctcttttggctttttccacaagtctccgattagccgcattcattgtaccaaacttatccacacaacaaatgacttctgcacaatcatccatcattttctctgctttttccagatgttcttctgtaacagcctcgaatggttcttcgctgatcacctctgctgccagtgcttttgcaacatcatagtccagatcattactgtggatcacacctgcaataaatggaatacccgctctctgcaattttcgatataccggaattcctctgccatttccaccaatgacaaatacctgtggtttacctgccggagcgcccatttccagacatccaaaagaagcattatagcttcccgttgtaattccataaagatgatggatatattcggatgtaaaaatctcctccggtgtaccgtatttttcgatccggtcaccatggacacagatcacataatctgatattttctgagccagatccagttcatgaagcgacatcaacacagctgtgtgatgttccagaaccatcttctttaatatagaaagaagttccagtttatgacgaatatccaaaaaggaagtcggctcatctagaacaatcacttctggttcctggcagattgctctggccaacagaatcctctgtcgctgtccatcactgatctcggtaaaatctctgtccttaaaatccagtgcatggaccatttccattgccttatgtaccttttcccagtcaccctccgataagattcccagcgtacctgtatacggatatcgtcctgttgcaacaatatcctcacatgtcataagctctggtcttattctctccgtcgttacaacggccagcttctgtgcgacttccttgcctgacatctgactcatcagtttctgatccagatacacagttcctcctaccagctttagctgtctggtaagactcttcaatattgttgattttcctgcaccgttcggtccgatcagagtaaggatttctccccggttcaatcgaatttcaatatcacggatcagtggctttccatcgtatcctactgtcatctgttcagaatgaacaaaatattctcccatcaggccatcctctttcttcgaatcataatgtagatcacaaccggtgctccaaatactgcagtaacagaactgatactgagttctgtcggtgcaaaagcagttctagcaatcaggtcacagaagaggcagaagacagcgcctcccaggaaacatcccggaatcaccagaagcggcttggatgttttcataagactttttataagatgcggtactgcaattcctacaaaggagatgggaccggcaaaagcggtcacacaggctgacagaatactggaaagcaggatcagggcaatacgaaatgctttgatatttactcccatattctgtgcatagccctcgccaagctgatatgcactgatcggcttggacattaaaaatgtaagaaaaagtgcagcaaacacaacaactgccattacagaaacattatcccagctggttccggaaaaacttcccagtgaccagttatgaagattgacaatattggaatcatctgcaaaagtgaccacaaaatctgttattgcagaacagatatatccaatcatgataccgcttacaacaagcatggacatctgctttacctttcgcgagatcaaaagcacaaatcccatggatatcagagatccggtaaacgcagccaggatcatcagtcctgaagtagctaccatggattttcccagcagatagatcattgtcaatgccacgatcagttttgcacctgatgaaataccaagtacaaaaggacctgcgatcgggtttccaaaaaatgtctgcagaagaaaccctgatactgaaagcgctcctccaagaatcactgccgccagtattcgtggcagtcttatctcccagacaatattataagcagtctcatctccgtttttgtggaacagtatctgaaatatatccttcagtgaaatagaaatacttcctgaattgatattccagaatataaagaccagcagaagcactatcagtattataaaagacagccagtatctgaaatgtaatttcttccgcatgttacttcctctcatcattttaatttatgcatataagtcagtgtatccagatttggatcatctgaggtcagcatggtatgaatatcttcgatcattgttccaagttccattgtctcctgaaacagattctgattggtacaccagacatttccatccttaactgctttaaaatcagcaagcagagaactcttctccagcatctggctgatatctgtcagttcaccatcgatcgtactattgtagatgatataatccgcatccttagctccggcataaaactcttccatctgcatattcattgtggaaagagagttatcatcctccgctccaaggtcactgaaaatatattttccaccggcgagttcgatcatcttggatacataatctcctgacttacgaacattggcagcccctactgaattgatatagaagaaagccactgtctttccggtagattcactgtcctctattgctttcagtttatcaacctgttcctgaaaaagtttgtctgcaagttcttcttttccaagaagaaccccatatagcttcaaccactcagtacggccaagcggatgactttcgtaacttgaatgctctaccagaaccgggatcccgaactgctcaagcttttcttttacttccggtttatggtagatcattgtagactcaatcgccagatcacaatttttagacaaaatcagttcgtaatccggtgcactgtacttaccagcaaaagaaatacttccatcttccagtgctttcttagcctcgtcgatataccatccgtcagcattggttcctgaaagactgatactgtccagcccgtccaatgcacagaaaagatccattgccgatgttgccacaagatagatattatcaagtggctgtttaataactgcaatatcactgtcaaggccttccggagcttcttttccttccggaacaagaagaaactgcccatctcctgcaattgtgataagtgcataaccatcttcataataatctactgaaaactgatctgcatactgaagttccagactgtgatcatattttaagccagccagatcctgtctgacagcattgctttctgttgtttctgttgtctctttttcttcagccgcctgaaccaaagcaggtgcagtcgccatcatagatgcggtcagtgccgcacataaaaacatgcgtaacttttttttcatctttatttttcagcctctttgatacttgcagaatcaaactgtaaagtatattcaatctcatgaggagtactcatcgcaactgtatctgctacaacttccattggataatcaaatccatcgactggtatttcaaacacagaattaccatccttattaactggttcgtatttttcatcaccaatcagcatatagtcatagtacggactgctccattctacagaagcggtcactttgccatccttaactgtaaatccagtcggactggtaacgcttgctttaccagaaccaccttccatttttacttctgctgtatagtctccgtcttccagtttcagatcttcagcagttactttttttgcatcagtttcttttgtatcagaagcttcagcatcggcttctttctgaggatttgttacttttactttatgatcgtaccatttgttcttctttccgatcagagcaacgtcaaattcttcgtcaatggcaggaaccggaatgtcaaatccataaacttcttcggtatatccatcactataggttacttcatctgttgtcggctcaagaatctcagctccgtctttctgggcatcatctgcctttccaacaaaaaggtttacaatcttctttgaattcaggcttacatgaatcgtcattttaccgtctttgactgtcagtgttcccttaccgtcatttgcttcatttacatgaaacatggagctgtcggtatcaaattctgcactgtaagtaccgtcttcaagaacttctacttttgaagtatcttcttttttctcagattcatcctttgcttcatctgttttggaagcctctgtcttctctgttgtttccgcaaaaacaaccggactataagcactgatcataagtgctccgcttaatacgcatgccatcattgccactgaacgtttcataatataaatcctcctgattttacaggaaatgcccggaagacaatcaagccttccgggcagtcccgtttattgcataaattatttacacattacattattctgctgcagaatcgtctgtaacttcttctgcaccatctgttgtgtcatctgctgcttctgcagtatcatctgttgtttcttcagctgtatcagctgttccaagagaatcaattgctgcttttgtatgctctacgtaaagatcctctacagcttcaattcttccaagacctgcgatctggcagtcaacgctgtcaaatgcaccagatgcattgaactgagatttccaggaatcgtcatcatcaccagccatatcgttgtttgcatggtcaccagcaacgaccatcagcggacgaagaacaactttcttgaatcctgcgtctttaacttttgcaataacagcctggcattctgtatcttctggcttaccttctacagttccaatgaaagcgtttgtaagtccaagattatccatctgtgactgcatctgatcatatgttacatttgctgtatgggaagtaccatgtcccatgaatacaaatgctgttccgtcttctgcagctgcttccatgctgtcatatccagcttctttgcaagcttcatctgtgatagcctgcgcaaccgcttttttgtcatcgttgattactgtagcatcttcaccaacttcaccaagcattggctctgcgatcgcaacagattcaaatttatctttgtatccatcaattgcttctgtcatttcatcatattcagcgccatgcatcagatgtgtaggctgaacaacaagatttttaacgccattatcaactgcacggtcaagtgcctgctgcatattgtcaatcacttcatcatctcttgcttctacatggttgataatgatctgtgctgtaaatgcacgtcttacagaccaatccggatatgcttcctgcagtttgtcttcgattcctttgatatcctcagcacggctgtcgttgaaggatgtaccaaagcttacaacaagaagttcgttctcaccgatttcatcctggttacgaggatcatctttggatgcatcaccagtgtcacgtccgaagtaatccggatcagcttcttcgccttcaaccagttccttctgagcgtctgtcaatttatcccatgcttctttggcagctttgcagtcctcatctgttgtatcagttctttcctgaacatagatcttgtcgatcagtgctgctacttcatctgctgctttctgatcatcatcggaagcttcttctgtatcagcggtttctgcatcatctgcggtttcttctgttgctgtctcagcagtgtcatcagaagcgtagatgcttgcagatcccatcattgtgactgttgctacagtcattgcaattgccagtgcttttacagttttgtttttcatgtttttttcctcctgtacctgttttctcatgaaaattaaaatgaataacaaagtacggcagcaagcctggtcaaaaaatatttttcggagaaatactatatttcccaataaaaaaactcctgcaccgggctagagtttctggattatggtacaaccaattactcgtgatccggaatttaaaatccccgtaccaatagcaggcaggtttcctgacttacagatcaatacacccgaatcgtcttcccagtttcccagtgactgtgcatacacacatgattctgcattccctgtatacagtgacgagatcgtacaggacttacacctgtttcccttttaactgaaggctatttgattatctaacatcagcacctgttatttttattattcaatttcttacagaataccactattttggtcaatttacaatagggcagttatttttttaacactaaatcgcacgacggaagcagatacaaaaacactgcaaataagacgctgtatcccggtgcacctgctgctgtaagcggaacagcacacgcgatcgaccacggcaccaaaggtgctatgagcactgcactgtcctccagattattggcaaaacgcagcttatccggttctgttctgctgcagagctgatctgtaagcatgattgccagtgtctgattacatgccataacgcttgtcaggattgatgtgacaagcactgcaaaatatggttttgtcctgtcggcaagcaaacagaccattttctgaaatccattcaggattcctgttgcctgaaaaatacctgaataagatgaagaaatgcatacgattgctccaaccttcaacatcgaagtgataccacctccattcagcattgccgctaccgtcacatctgtagaatggaaaccattcagaagaagttcaggaagttccgtaaatgccatattctgaaggccaatacagacaggaattgcagtaactatactggcgatcatcgcgatcttcacccctgcctgcacaacagacaacagcagaatcaccgctgcaggcagcaatgcaatccagctgagccggaactcactgccaaaagcatgtccaagatccggcatctctgtttttccatgaagctgtatgctgacagtcagataaagaatacaggtaatggtaaatggtgccaatgcacttttgatcatattttttatatttgtatagatacctgtctccgtcagctccgccaccagaagtgcacttgtcgaaacaggagaacaacgatctccgaaatataccccggaaagaattgcaccaccggtcatccatgaaggaattccaagtgcagaagccatcgttgcacatacaacaccaatcgtagctgccgtaccaagagcagttcctgtcaggactgagatcagacaattcagaagaaatgtcatcagcaaaaatgtcgatggttttatcagatgcacggtataacagatgattgcaggaattgttccagcctgtcgccaaagtgctgtcagcattccgatcagtataaatgtgagcagaatattttttactttccagactccctgtaatgccatcctgctaatctgtctccagctatatccctgtttttttccatacaggctgaaaatgatcagacctgccagaagagcatataatatagattttcccgttatgatgcatataatgagcaaagcacagaaaatcccaatcatcagaacttccatgatcgttttcctttcatatttaatgcgttgtcataataacatggatgaaaggaattgtaaaatcctgtatttaccctaaaagacccggaagaatcctcccaggtcttatttgatatttctttgttgttatgaatttttacaggacgcctcacatggacagtcaaagctcggattgaatgcatagaagtttttcgcatccagctgttcctgtacggaacgaagtgcttccccgaaacgctggaagtgtacgacttctctcgcacgtagaaaacgaatcggatctgcaatttcaggaatgtcacggacaactcgaagaatattatcgtacgttgcccgggctttctgttccgcagcaaggttttcaaacaaatctgtgatcggatcacctttactctggaattcacatgcattgaaaggaactccaccggctgcctgtggccatacacctactgtgtgatcaatataatatggcccaaaaccacttttttcaatttcttccatagagagatcttttgtcagctgatgaacgatcgtggaaaccatttccaggtgtgccagttcctcagtgccaatatcattcagcactgccatggccatgcgatttggcatagtaaaacgctgagaaagataacgcatagatgctccgatctcgccatccgggccaccatactgactcatgatgaactgggcgatctttgcatttggagtcttaatatttaccggatactgcagtcttttttcataattccacataaactatctgcaccctccttccgtttcccatgggaatggctgctgcacccatttccatgtatccccaccagattccagtgcagcatctactgtcagtgggccataacactgcgcatattctttcagcagtttctggcgttcctgttcacactcctgataaaaggagattgcctcttcacagcatggatgtgtatccagataaagcagaacatcatttactgcaaaactgacttcgttgatacggttcattaatttttcttttgcagtacactgattgcgatacatcatctctgcccacctctctttccacaaaatggtttacagagctgcggaaaaacagttccgaccttcaacgcatatccaagatcatatgtcgtagtaaatttctggcagggaacatacgccatggctgcttccatctgatcgatgtgtgtatacatttccgcatctctggttttggcatccggaaggtgacacgggcatggcgaagggcgggatggctgatttctggaattattacggcaggaacactgctgcccggacatcatctcttttgccattccacaagttgcattatatgggcggccacatggacggttcatctgataattttccatgagcaaatcctttctgtcacaaataatatgtctctatattttatgacataaatatggaatggtgcgcatatctgcccataaaaacagctcccttcaccggggagctgcacatttcttatcgcattactcaatcacatatgcatctacgatttctccgtaatatgcaatgtgtgtatctctgtttgcacctgaaaatgaactttctacattctgtgggtaaaacttctctctgttttcctctgtcatggcctctgtatcctgtgtctgtttatagactactttgcattccagtgtcagtggaagttcttttactcccgggacagaaattgtttccggttcttcgtaagtcagaccaatttctttcgctttatctacatcccttcctgattttgccccacagtatccaagaattttttttgcactgtcatccagtggaatattaaccgtaaattcgccattcttctcaagaagactccttgtaaaacgactttctctgacaaatgtaataaaaactggttttccccattctacgccaaccattccccaggaaattgtcatagagttcactctgccatctgcttttccggtaatcagcactccattttttactccgttcaaaatttctcccatatgttcaaaaacatctatttttttcttcatgatcttattttcctcctgttagtttacatacatttcttttgtactttatcttaagataaaaaacaggaatctgcaagtattttgtactttatcattcacgtttttaaatgtataatagaagtactttaacaaaggagttcagaatcatgtcaccatcaaaatccaaaaatcttaccccttcctatgcagtcatccagggactgtactggatgtattttgcagcaatcatgagtttttccggtttttttcttctttccggtggatttaccaatactcagattggaatccttgcagctatagcaggacttctgtctgcagtactgcagcctgtccttgcaggttacgctgaccagccacaaagcccctccctgaaaaaactgatccagatgctgtattttcttcagctgatccttgtgatcggattatttttatcccattctctcatacttaccggacttctttatggttccagtattgccctgctgcaactgatgactccttttattaattcccttggaatggaaagcatcaatcagggacattctctcaattttggtcttgcacgtggaatgggatctgtcgcttatgcctgtatctgttacattctggggatcattacggtaaaagccggacctgtttccatcccgatcactgtaattgtccttaccctgctgtctcttggtatccttattctttttccattttccaaagcaaaatcagacagcactgccacgaatgctcccaaaagcagctcagacagtaatccaatactttttttcaggaaatacaaacgtttttccctggtactgctcggatgtatctttatctatctcagccatgttctgctgaataactttaattttcagattgccctggcaaaagggggcggaagtgcagaaatgggaacagcctcagcaatcgccgccatatgcgaattaccaacgcttttcctttttggctatatcatccgcaaatttcgctgtgaccttctgctaaaaactgccggtatctttttcacgataaaagcacttggcacgctgcttgctccgggtattccggtattttacggcgtacagatttttcagatgctcggatggggacttatgactgcagcttctgtttattatgtaaatgccctaatggaaccggaagacgcaatcaaggggcaggcctatttcacaatggcatatacccttggaagcgtacttggttcttttcttggcggaacactcatcgaccttgccggagtacacgcaatgctgctcttctcaacagtctctgcattcattggtgcactgatcgtactaatctttgctgaacgtacttcaaaataatattccaaaaaacaccgcaaacagatactactttcatctgtctgcggtgtttttcatttgttatttttcatttattatttttcatttgtttcgtttccatctgctctgtttattcgcacaaatctcattccactgacaattcccacagatttccacccgttttcctgactcgatcacatttttctgcacattttccacaaattcctgaaatctcatctgtactttttcactgagcccgcatgcttcaagcactttacggtcataagcttccaccagaccggcactcacgcaacttccctctttcagattcggacactctttacagatttcatctccggatacggtaagctcaatatctgcgcctttttcaaaaaactccagcatcttctgcatatttactgtgaatccgtcactgtagccttttccttcaaaatacgcaagacacattccatgatgcggtcttaaacagatcatgctacaaatttgcggagctttctggaaagaccataagccagaacaattttaataatatccggaatgataaatggaatgacacaccatcccagaacagttgcaagaccaacggcaccattcgctctgctgtaaacgatcataaaccatgcagtaccaaaagcatagcatacgatcagtcctacgatcatggacacaatctgcattacggatttcttacccggaagtttttccattgcccacataacaagggcagaaaacagaaaaccaataatatatccgccagttgttccagcaagaacaccaatacctccagaaaatcctgcaaataccggtactccaattgctccaagcagaataaataccaatatggaaagtgttcctctttttccaccaaggacacctaccgctacaaaaacgccaaacgtctgcagtgtaaacggaacagctgccggaatggatatccaggaacagattgccataataactgcaaatacggcaatgtacacaatatcataagttttacttctggttgctgctattgtactcattttttctcctcctcgtgatgacagttctatctgttatctatttaacaatttaacacaggcctttccaattgtcaacttaatataaaaagaggtttacattttaaaaaattatatccttaaatgtaaacctctttttataatattatttatcgtcaactatttctgttgatgtacataaacctccatctggttatatggaatcacaattccgttagcatcaaattcttcttttatcttctgattcaggcgccatttcgttggccagtaacgttctgtcgacacccagacacgcaagcccatgatcactgcactgtctgcaagctcgtccacaaacacaaccatttcttttgtgtcgcttttggtatctgcatcttctctgagaattttctcaatgattctctttgccttctgaatatctgcctcataggaaattccaactttgatctcaagtttacgattctccttggccgttacatttatgatcgtactgtttgacagtgttccatttggtaccacaatttttttattgtcaatgctcagaagtgttgtatagcagatctcaatcttggcgaccgtaccctcacacccgtttgactgatcctgaatgatataatctccaactacaaaaggtttaaaaagcaacaaaagaactcctcctgccagatttgcaagccctccctgtagtgccagaccaaccgtcacacctgccgtaccaagcaatgccgctacagaagattcctttacaccaaggcttactgcaatattgatgatcagaaggacatacaaaaccgctttcccggcagaagaagcaaactgtatcacaccagcatccacattggctctctccagagatcgtctcataacattcaatatccactgaatgatttttcgtcccacgaagaacacaattactgaaagaacaactttaatacaaaagcccataactgccggaacctggttttccatatactgtttaaaattcaacagatctttcagactatccttcacaccgtcaattcccatttcctgcagaccttcatctactttactgacagtttcactgactgtatccataaaaaatccctttcttttttcaatctgtaattgtatctatcatacatctctgatattttcttttgtatttattaatataccatgatttttctgcaaaaactattttaaatatttaaaaatcccatatacagtgatataatggaaacgcttataataattatattctttttacggaggaaagcatgcatattataattgtcggatgcggcaaagttggaagcacccttgcagagcaattacaggaagaagatactgatcttactctgatcgatacagatgcagacgttatcaacaatctcaccgaagatattgatgccatggggattgttggaaatggagccagcatcaatacacttatggaagccggcgtcaaaactgctgatatcatgattgcagtcaccgcttctgatgaattaaacctgctctgctgtctgattgcacagaaaaccggacattgtcagaccattgcccgtgtacgcaatccaatttacagtaaagagattggttttattcaggaacgccttggtctttccatgatcatcaatccggaactggccactgccagagaaatctcaagacttctgcgttttccggcagccatcaaaatcgatccattttcaaaaggacgtgtagaacttctcaagtttaaagttctcccggaatttgaactggatggaatgtcagtttcccagatcacagacaaatatcgctgtgatgttctgttttgtgccattgaaagtaaaacgaccttaagcatcccgggcggtgatcatctggttcacaatggcgattttatctctattatcgcaacacccaaaaatacagctcttttctttaaaaagattgggctgaagacacatcaagtcaaaaatactctgatcattggcggcggcacaatttcctattatcttgccaaagccctttctgatctgaagatcagtgttaagatcattgacaagaacaaagagcgctgtgaagaactcagcgagatgcttccaaatgccacaattatctgcggtgatggtacagaccgcgcacttctcatggaagaaggtctttccacagtagaatcctttgtcacactcacaaacatggacgaggaaaacattttcctgtcactgtctgcaaaaaatatgacacaggccaaactgattgccaaagtaaaccgtcttccttacaaagacgttatcgatgagttggatattggaagtgtgatctacccgaaatatattacctctgattctattctccggtatgtacgtgccatgcagaatactatcggaagtaacgtagaaaccctttatcatgtgcttgacaatcaggcggaagcgcttgaatttatcattcgtgataattctcctgttgtgggaattccactttccaaactgaatctgaaaaacaatcttcttgtttgctgccttacacgtgaggggactgtcagaattccaagaggacaggattccattcagattggcgacaacgtgatcattgtcacaacccataagggacttcgcgatatccgcgatattctggcataagaagggatgtatacagatgaattttcgaattattgcttatatcgttggatgggtgtgtaattttcaggcaatgttcatggttcttccatgtatcacggctctcatttatcaagaacatgaatttttcgcttttctgatttccatgattgtctgcctgatcgtaggtcttccactgactatccgaaaacctaagaacaaagttttttataccaaagacggatgtgttgcagtagctttgagctggtttgcactttgtatttccggtgcagtaccttttgtcctcagcggtgctatcccacatccaatcgatgctttttttgagacagtatctgggttcacaacaaccggatccagtatcctgacagatgtggaagttctccctcattgtattctgctatggagaagtttcacacactggatcggtggcatgggggttcttgtattcttgctctcactgctgccacttgccggcgggtatcatatgaatctgatgaaagccgaaagccctggtccttccgtcagcaaactggttccaaaagttcagcagaccgccaaaattctttacacgatttatattggaatgacactgttccaaattattcttcttctgatcggcagaattcctctgttcgataccctgtgtatttcttttggtaccgccggtactggtggatttggtatcgtcaatgacagtatgggaagctacagcacctactgtcaggttgtcacaacgatttttatgattctttttggagtcaacttttctgcatattatcttcttcttacgaaaaagtttgtgcaggcatttaaatttgaagaagtacgttattattttggaatcattctcgctgcaatccttgtgatcggattaaatacagctcatctgttccgcaatctgggtgaagcatttcaacaggcagcctttcaggttggttctatcattacaacaaccggtttttccagcacagatttcagccagtggccctctttgtccaaaacgattctcgtacttctgatgtttgtcggtgcatgcgccggaagtaccggtggcggaatcaaagtttcccgaattttgattctatgtaaagcagccaaaaaagaattccagttatatctgcacccgaatgcagtcaaaaaaatcaaaatggatgaaaaaacgattggacatgatatcatcagatctacaaacatttatctgagtgtatatctcctgatcttagcagcttctgtccttattatctctctggataattttgatcttattacaaactttacagcagtcaccgcaacattgaataatatcggtcctggtctggaaattgtaggcccgatggggaacttcagttccttttcctatctttccaaatgtgtgttaatttttgacatgcttgccggacgattggaaatttttcctctgatgcttcttttctttaaaggaacctggaagaaattctagttcacaattttttcaaatttataccatatttttttcacatttattaggtatattaatatgcatagaaggtgcatgccttctataaaatatttttctttttcatacgcgccggtacgaaagtaccggcctccttccatttatggaactttttttatttacgcaacgtcaaaagctctgtcgtatcaattactgatacaacagagctttttattactgtaaattatcgctgatcgtctgccagatactgctgttttcaaatcccagcttccactgtgcaacacccgcaagattatatttcggaatcagtttcactttctccgcgatcgattgtgcatcttccagccaaatctgatacgttgaattatctttttcaaatgttgcataattctgactgacacttccgtcccatacagcttcaacgccattttcagtaaggacattctgtgcttcatccattccaatcgcctcactggtcagagccccaccagttgttttccaaagtcttgtataaaacggaattgcaagaactgttctttctgccggcgcttctgcaatcgtatcctgcacgccctgctccacccatggaagagaggccacagatccggcatctgaccctacataatgttcatcataccccataataacaatataatctaccaccagtccttgttctctgcggtcataatggctggtaaaatcttccggaaccggattatctactgaaagaacaagattattcttatgacattcaatagaaagttctcttaaaaattccaggaaatgaggtcccgcatcttcactgagtgtctcgaaatccacatttataccatctagcccaacggtagttgctgactgaatcagctgctgaatcatattttgtctggatgacaactgtgaaagtgtatccgttgtactcacttctgccgtaaaattatcaatcagtccccaaacctttaatccgcgttcatgtgcaagtgccacatagtccgccgacgcaatatttcctatatttcctgctgtgtcctgaatataataccatgtaggagaaattacatttacaccgctgacatttgcaatcgtgtccgccagatatgcatttgcatcctgacttgtcacctgatgccagctcatatttacttttccatccatagtaagataggtatattcctctttctcaaatgatctctcaaaatcttttgtctcagcagatgctatcgtatccttctgaacatatcctatatagccatccattgtagcaacctgggcccagtcttccagttcttccagaaagatcaatgtatcccccgtcttcacatctgtcaggatcggagacttgattccaccctgatagcggatacttgtatcttttttaactgtcgttgtctgcactccggtaaatctgtactggattgcaactctgttcggattttcatatacataggcatccaggtctgtaaatttctgcacgaaaccaagacgcagataaactgttccatccttcagccatacatcgccttctccgctctctgctgccggataatactgcaattcagaaggtgtcgcataaagtacttgctggtcagcactatcccagtaatatctctgattcagatatgtatttaccatatcaagtggaagatatatctgatctcctgacatcaatgcgcgttcttccatgatttcagttcccagaacaactgccatttccccatctccgggctgtccataatattctgtaagattcattctttcttttgtaggaatatatttcttaataaaatgcattcccagccccataactgccagcactaaaatcaatatgcagacaattacgacaggcatgtgttgacttctcgtttgtttttttgcctgatgcttcatctgtttctccctttaatttcagataagatctgtaaccattctgtgttgcgcttctttttttcttacgtatcgtaacactttttacgctattctcagtaacctgattattacatatacttttttattataacatgctttactatataatgtcttaactaattataaattttcaaatatttcctgtacagaatcattacctcagactttttaattttgtgcaggattttccggtctggttaagtacgagaggggaaactgcacttgtaccggaaaatcgctgcaatcatcttatgtatataaaagcaggtatttatcatcttctgtttttgggaagttccctgatatgttcaaagttcacttttgcaatcctgccttcttcatctgcagtataatccctcatgtaaccaccgtcttctgcgatcatacaggctttcgcaatacatttcggtgtactgggatttccattcagaaaaagtctgacaccttgtttccgataatcttttaattcatccttcaaaggtttcaatgactttttactgcatttactgtgtgacatattttatttttttcggccctcctttcctgaaattgattttagaaaacacctgataggttcaagaaaaaataatcctccgtataattgaatttaatcttatggtgggatttccacactgccccagcaagaacgctgtatgatatgttgtattaccggcaatgatatggaaggaaaatgtattgtgtaagttttgcctctaatctgttcttcagctatatgacgaatattttttcttattcctcattatacagagttcctttgtttatgcaagcctttttagcactttatctaaaaattcccaattaatttctaaatattttataaatagacaggttctatttctttacattttctatgattgtggtatataatatgtcatattaataagtcatggactatatagcctgtcgttctgatattttcatataatatagcagagacaggtgcataagaataggatgtgatcataatgaaaatagaaaaaatcaatgaaaatcaaatccgctgtacattaacccgagaagatctcgaaagccatcaggttaatctcaaagagctggcttatggttccgaaaaggcaaaaaaacttttccgcgatatgatgcagcaggcacagatacagttcggttttgaggctgataatattcctctcatgatcgaagcaatcccggtcaatttggacagtgtcatcctcatcgttactaaagtagaagatccggaagaactggatactcgtttttccaaattttcaccatataaggataatgctcaggcagaaccacttcaacttgacggagcagacaacattattgatatcttccagaaaatatgtgaggcaaaaatgaaaggtactactcgcaagcaggccaatcagaaagaaacttctgagaaatctgctgcctcttctgaaacaccgacagttgatctgatccggttgttcagcttctatcatttggatgatgtcatcgctgctgcacacggtctgaatggatttttcacaggcaaaaatactctttataaagattcttcagacggtcgttaccagcttgtccttcatcagtctgaatactcaccagaagaattcaacaaagtttgcaatattctttctgaatatggatccggcagagcattttccgcagccggtgaagctcatctgaaggaacatggagaactgatttcttccagtgcccttcagcaacttacacagctttgataaacaccatgacttataaaatgcaaaaaagactggcccgaaagccagtcttttttatgcggtaaatccgtgcttattcaccaaggaaatcattgatctgctgaaccagaacatctgcgtccattccatgaaccatagctgcttcttccagagattccatctgtgaagacgggcatccaaggcagtgcataccagctctcatgagaattggtgcaatattaggatctaaagtaattaactggccaatcagcatgtcttttgtaacttttgccattgtaaattgcctcctttaatatggaattcttaaaattcccgactatgatttattataatataaaagttagaagcggtcaaccaaaaatatcaatttttttgcttgttcacaattttatacttgtaatccataaagatatatattagaataacgatatagaacctgtaagggtactaacgagaataaaggaggatactataatggcatatgtaatttctgacgaatgtgtaagctgtggaacatgcgcagctgaatgtccagctgaagcaatttctgaaggtgcagagcatttcgaaatcgatgctgatgcttgccttgactgtggaacatgcgctgatgcctgtcctacagaagctattcacccagctgaataatttcattcatatcaaccaaaaagctgcagcgtctgctgcagcttttttatattccgttacttatcccggcgccttcgtccagattttttctcagcagcagctgctgcctcttttcgtgcaagctgctgtctgcgtatcgcataatcaagcgatctgcatctttcttcatcttcattctgtgccttcagttcctgcgtgatcagtctttcaagaatcgcctgaaattctaagatcttatcatttttcccctcgtcttttttggatattttttcttttaaatccctgtctgtttttacttcagcatgatctatgacttctccttccagaagtgttgatgcactttctccaaatccggtcatagatgctgttatctgagggatcaggttcttgattgcccgaagctgcaatcctcttttcttcagttctttaatattcaaaaaaagttgaatatcatatccggtgtaataacggtgtcccaattcgtttctgtgaatctgtagttccagttcctcttcccagtatcgcaggacatatgacttgactccagtcatttccaccgcctgtctgactgtatatcgtgtctccatcatgcacctccttatgaacttcattacattttattataaaaagtaacccttacgaattcaacaaaaaacgttcgacaaaaaagcaggcatccacctcagaactatgtttattcttcggtagatacctgctttctgcttttttattatttcttcatgtttacaaactgtgtatatcttggcagccataccagttcaatcgttccgattggaccatttctttgtttggcaatgattacttctgcaatatctttcttctctgtatctttgtgataataatcatcgcgatacaaaaacataacgacatcggcatcctgctcaatcgcaccagactctcgaagatccgaaagcatcggtctgtgatccggtctctgttcaaccgcacgactaagctgcgacagtgcaatgaccggtacactcagttccctggcaagtgccttaagcgaacgagagatatcagaaatttcctgctgacgtgaatcacttttgccactgccactcatcaactgaagatagtcgatcataatgattccaagattatgttccagtttatattttcgacatttggatcgcatttccgcaatactgattcccggtgtatcatcaatgatcaggttggaacgtccaatgatatccgctccttccaccagctttgtccagtcctcatctttcagattgccggtacgcatattctgtgaatcgacatgcgactccatcgccagaagtcggtttacaagctgttcctttgacatttccagactgaatatcgcaaccgtaacatctttacgaaatgccatatactgtgcaatgttcagaacaaatgcagttttacccatagaaggacgtgctgcgatcaaaaccagatctgacggatgcatacctgacgtcttgtaatccagatcgataaatcctgtcggaataccagttacactgcctttcagtttggatgccttctcaatgttgttgattgcattcaacacaacctgctgaatcggtacataatccccgccaatacttctctgcagaatattaaacagtttcttttccgactcttcaagaatcatctctgtactttctttttccagataacaggtatttgcaacatcttctgtcgctttgatgaggcgacgcaaaagtgctttttcacttacaatattggcataatacttcacattggcagaagtaggaactgcctcaataagctctcgtacatattccatactgctgatatccggaggaagatctttttctttcagtcgattctgcagagtgatcagatcaaccggcttcccttcattacaaagctctaccattgcatcaaaaataatgccatactgattctgataaaagtcatcacttgtcaggatttccgatgcaatcagaatcgcatctctgtcaaggagcatggcgccgatgacagactgctctgcctcaatactgtgaggcggtattctttttatcagcgcttcttccatagcagattctccttacttatgcttctttgatccatactttcagacttccggttactttaggatgcaatttcaccggaacctgtgtcacaccgagatttctgatcggacttggcagttgaagtttctttttatcaatatccagcccaagctgaactttggctgcttctgaaatttctttggaagatacagatccgaaagttcttccgccttctcctactttcagtgtcagaatgatttcttttgtttcaagatcttttgcaaatgcctgtgctgactcaagattttcctgtgcaactttttctgcattggctttctgaagtttcaggtcattcagattcttcggagtagcctctactcccagttttttcggaagaatcatatttcttgcatatccgtcacttacatttacaatggcgcctttttttccaagtgcctttacgtcttctaataaaattactttcatttcttgcctttttcctcctgatacaactcatctataatttctttcagcatatcctgtacttcgtcaatcggacgttttacctgtgcgccggcaatattaatatgtccgccaccgccaagtttttccatcattacctgtacattaacttcatcgattgcacgggcactgacataaacttctttattatatgtggtcagtacaaatgatgcttttacaccggcaatattcaaaagttcatttgccgcctgtgcaccgacaactgtcggactttccagtccctcactcggacattttgcaatagcaaagcatcctctgtagatttctgctgttcgaacagcttccgctcttgctttataagaatcaatattatcacgaagcatcttacgcactctggtcatatccgcaccggaacgacgcaggaatgcggcggcctcaaatgtacgcacaccggcccgtgtaatgaagttgtttgtatctatcataataccggcataaatgcaatctgcctcaatattacgaagtctaagatcatccgagaaatactgcaggatctcagctaccatttcacatgttgaagatgcatatggttctacataggataataccgcgttctggatcacttcgttgcctcttcggtgatggtcgagaaccacgattgtctttgtcatgtacaaaagttcttcgcactctgtatagcttggcttatttgtatcaacaacaaccactaccgtattgtcatctaccagttccattgcctggttccggtcaatgaacatagatggttcatagtccggattatttatatatccagccataagcggacgtatggatgtagatgggtcatttacaacaatgtgtaccggtttgccaagtgtcttacctgcacgataaataccaatagccgcgcccagagcatcaacatctgtgatcttatgccccataacaacaacacgttctttagtgctcatgaactctttcagcgcctgtgctttgacacgggctttgacacgggtagtcttttccatctgctgggccttaccaccataataagtaatgctgtcaccgtttttgataacaacctgatctccgccacgtccaagtgccatttcaatggcaatacgtgaatactcatagttctgaagataagttgcagcattcagaccgataccaatacttaaagtcactgtcatttcgttaccgatattaacagtttttacttcatcaaggatatggaatttctgctccttcaacgtttccagcgaactctgcctcatgatcagaaaatatttatctttttccagttttcgaaccaggccatcataattggaaaaatatttcgtgatcttacggtcgatcagagcaatcagaagcgatcttctgacatcttctacactttccagtgcttcttcataattatccagatatgcaagagcaacaacaagtttattgtcttcattcgcctggatatattcctttaactcagtctcatcgtacagatacattgcaataagactcgttgttttcggaatatccatcagcagtttggacggtgcaacagactctcccagaaaaactttctgcatagagatacgataaatgcggtccccaaactgggtactgacttctgtgatatcttttccatcatgtcccggaagtttgttcgctgtaatatccggaaagatcgtactgacattctttctgtaaaacggatcttttcccgtcagctgagaaaacattctgtttgaccagatcattctcccttgcatatccatcactgcatatggaagtgccagttcttcgagtactttcttttccagaaactcatactggctggcaaaagcaatcagatcattaaacatcaatggtctgtgataaaacagaagtgtaatcgctgccacaagataaaggacgtttcccatcgtgacaaccacacctgctttgatgttaatcacatataccagaatgttcaatacaatcagcagaacggacaaatacagtggccagcgggctaaatgcttcagatggccttttaattttaattttccactcataacactctttaccattctttttcttagttatttaaacgctgccttttattataccagatatccatgaattatgccagatatttcccacaaactaaaaaaagagctacgtccggaaagcatattctgcaatccggacacagctcccaaacttcaataagctatatcgatcagattagtcctgaacatatggcatcatggaaagatgacgtgctctcttaacagcaacagtcagagctctctgatgttttgcacagtttcctgtgattcttcttggaaggattttacctctttcagaaacatattttctgagttttgctacatccttgtaatcgatttcattattttctttaccgcagaatacacaaactttttttcttctgcgtccgcctcttctcttcattggagagtccggtctttcgcctctattgtaagccatgatggtttcctcctgttcttatttctttcagtttagttaaatggaagttcttcgtcgattccatccggaatattcataaagccgtctgcgcttgctgcccccggactcggcatagacggagccggtgctgcattctgctgaggatgtgatgctgcatagctgtcactggaagctttactctcggcaaattcctgttcctcaactacaacttctgtagtatatactttctggccatctctgtttgtgtagcttccggtctgaatacgaccacttactacaattctgattccctgatggaagtacttctctgcaaattccgcgccacgtccgaacacaacacagctgataaaatctgcagttgcttctccgtcacgacgaaatcttctatctaccgctaatgtgtatctagcaattgccagtgcattttctcctgcggaatatctcacctcaggatctcttgttaagcgtcccattaaaattactttgttcattaaaatacctctttcttcatagtgagtgaacgggtttcttaatggtgctttctaaaatccatctgtaaaaagattatgcgtctttacgaacgactaagtatcttaatacgttgtccatgatacgtacatgtctttctacttctgccggacactgtgcgtctgcttcaaactgaatgaaatagtagaagccttcatgcattttctgaatttcgtaagctaatttcttcttaccccattcttctacttctgtgacgtttccgttgtaacgagcgatgtagcttttagctttctctactactgcatcacgaacttcgtcttcaacttttgcgctcacaactaatgctaattcgtacttgttcatgctttcttacctccttatggtcttcatggccctctgcctgtatatcagagagcaaggatatgaaaaatatatcacacagttgattattctatcatagaaaattttaaatgtaaagaacttttttgtcgaataaattattttttataaatatcatgtttcctcaaaatacatacttatttaatcagttttatttcttgttattttgcataatttattgttttcttttccaaaacaagatatactgattgcacaaacgcatttgcgttatctcaggaaaggagcacattaaaaatgaactctgcattatatgcaaactatctgaacatcctaaaacaggaacttgtccctgctcttggatgtacagaaccgattgcgattgcatacgcagcagcaaaagcacatcaggtcctcggagaatttcctgactctgtaaatatgagtctcagtggtaacatcattaagaatgtcaaaggtgtcactgttccaaactccggcggtctgaaaggaatcgatgtagcggcaatcctcggcatcgttggtggaaatgctgacaaggctcttgaagtcttaagcgaaatcacagaagatgacattgccagaacccgagaactggtcaaacagcatgtctgttcctgctctctggtcgaaggggtagacaacctctacatcactgccaaagtaatcaaaggtgatcatttcgcctctgttacgattgaacaccagcacaccaacattaccaggattgaaaaagacggtgaagttattctggataatccatatcaggcagaatgcaaaactgtcatagacaaatctaaacttacagtcaaggacatcctagattttgctgatcaggtcagaatagaagacgtacagccgatcattgaccgtcagattaaactgaactctgcaattgctcaggaagggctggataacaactatggtgcacagattggtaaaactctaatgcatgtatggggcaaaagtgtcaccacaagagcttgtgcccgggctgcagccggaagtgatgcacgtatgggaggctgctccatgccagttgttatcaactctggaagtggtaaccagggaatgactgtttctctcccggtcatcgtatttgccgatgaatgggaagtatcacatgaaaagctctgtcgttctctcgtcgtcagcaatctgattgccattcatcagaaatattatataggaagtctttccgcatactgtggtgcagtcagcgctgcatgtggtgccggcgccggtatcacatacatgtatggaggtacttatcagcaagtatctctgactattatcaatacactcggaaatgtaggtggcatcgtctgcgatggagcaaaaccctcctgcgcagccaagattgcttcttctgttgacgctgctctgatggcttttcagctcagtatacagaacaagagctttcttcctggtgagggtatcatcaaggatgatattgaagaaacaatcaaaagtatgggttatatcggacgtgtcggtatgcgttctaccgatactgaaattctcaatgtcatgattgaccgggcagatatcaatcagggatgctgaaacataaacatagccgttactataacggaataaaacgtaacttataaacttttacagggggatttataaaatgaaaaaaaccagtttttttacaagccttccatttaaacttctagtaagcgttatcgttggtattattgcaggtcttattttaagcagcaccgactcctattccattactatgggaatcctgaatgttgttgtaactctgaaatacatccttggtcagctgatcaacttctgtgtaccactgatcatcattggatttatcgcaccttccatcactaaactcggtaacagtgcctcccgtatgcttggtgtggctcttgttatcgcctatgtttcttccatcggtgcagctctgttctctgttgctgccggctatacactgattccacacctttctatcgttacaaacgtagacggactgaaggaacttccggaagttgtatttgagctctctattccgcagatcatgtctgtaatgagtgcacttgttttctccatcatggtaggacttgcagctacctggaaccaggcaaaacttattacaggtcttcttgatgaattccagaagatcgtactttctattgtgtccaagatcatcattccggtacttcctttctttatcggactgaccttctgcggactggcttacgaaggttctatcaccaaacagcttcctgtttttctcaaagttattgtaatcgtactaatcggacattttatctggatgacacttctgtatgttcttgcaggtatttattctcatgaaaatccatgggaagttgtacgtaactatggtcctgcttacctgactgctgttggaaccatgtcctcagccgcaactctggcagttgcattacagtgtgccggcaaagccaaaccgcttcgtaaagatatggtgcagtttggcattcctctttttgcaaatatccacctctgcggatcagttctgacagaagtattcttctgtatgacaatctccaaaatcttgtatggctccattccagctccaggaactatggttctgttctgtctgcttctcggaatctttgctttgggagcccctggtgttcccggtggtactgttatggcctctcttggtatcatcaccggtgtccttggattcaatgaaaccggaactgctctgatgcttaccatctttgctcttcaggacagcttcggaacagcctgcaatgtaaccggcgatggtgctctgacactgattcttactggctatgccaaaaaacacaatatcaaagaacaacatcttgatatgattgacctttaaatgaatctccaataaatagtatttcataaccaaggttcccaaaccggagggttttgccgacttgacaaagctctccggtttcttctatactcatattaagtcaatatgaaaacagattgtaactttctgctttcattcattttttctgtcaggaggttaagcttatgcttttaaaaaacggacatcttattgatccgacaactaagacaaacgagtttatggatattcgtatcgaaaacggaatcatcacgaaaattgccaaagatcttacatctgaaactggtgaagaaatccttgatctgtccggccttacaattgctccgggactcatcgacactcatgttcatttccgagatcccggacttacttataaagaagatattcataccggttctcttgccgctgcaaagggtggttttacctccgtcatctgtatggcgaacaccaaaccaacagtagactctgtagatacccttaacgatatcctgaatcgtgccaaagtggaaaatatacatatttatcagaccgcttccgtttcctatggtttaaacggtgaaaaaatgacggatttcgatgctcttgccgatgctggtgcctgtggatttaccgatgatggaattccgctccttaacgccaccttctgctatgaagccatgcaaaaagcagctgcacttcatatgccgatcagcctccatgaagaagacaaagcatttattaccaataacggtattaacgccggtgaaacttctgcccaactcggtgttatcggttcacctgccattgcagaagaagtgatggttgcacgggactgtatgcttgcccttcgaagtggtgctactgttgtaattcagcatattagttctggaaattctgtagaacttgtccgcactgccaaaaaactcggtgctgacatccacgctgaagcaacccctcatcactttacattaactgaaggtgcactcctggaacacggcactcttgcaaaaatgaatccacctctccgtacagaaaaagaccgccaggaaatcattcatggccttaaagacggcacaattgatcttattgccactgatcatgctccacacagcgaagaagaaaaggcaaaaccgctgaccgaagcgcccagtggtatcaccggactggaaacctcgcttggacttggaattacttcacttgtaaaagagggatacctctctctgatggaacttctcgagaaaatgacctgcaatccagcctttctttataagcttccaggaggggtgattcaggtcaatgcaccagccgattttgttatctttgatcctgatgaaaaatggactgtcacagacttcgcatcaaaagcctccaacagcccatttaaaggatatgaattatatggaaaaatccattatacgatctgcaatggaaaaattgtatatgaaggataaatttgtttcacatttcaaatatataaattaatctattgttattagatgaagctcccctggtgtagcgatcttgctgtcttcaggggagtattttataccggcaggattcttctttactcttcataaatctgatcgaatacaccaccatctgcaaagtgagtttcctgtgccttgtcccatccgccaaagtcgtcaatggtcacaagattaacattcaagtcaaaaacatctgcatattctttaagaatatcttcattggatggacgatttgttacaagaaaggaatctcaaattctgaaaacgatgtcatttaaataaaaaaagctgcaggattcagcggtcttttgaccggaatcttacagtttttctgcattttttgtctattttatgaaaacgttatcacttaggatttataaggattataagaataaataaaaaatccaggataaactcctggattttagtagaggtgccacccggatttgaaccggggatagaggtgttgcagacctttgccttaccacttggctatggcaccaaatttaattgtttccttaaaggaagtgactccaaggggatttgaacccctgttaccgccgtgaaagggcggtgtcttaaccgcttgaccatggagccagatatttttgttctcggttctaggtccgaaaaacgaactccccctgttggactcgaaccaacgacactgcggttaacagccgcatgctctaccgactgagctaaggaggattattagaaagtgtatcacaccttcaaaactacatacatgttgacaaccaaccgaatcaattctgaccatgctttcttggtcaagccctcaccctattagtagcagtcagctccatgtgttaccacacttcaggagccctggtatttcttatagaataaacgattgcaagactaacttccacccccagttcctaatgtagagcaaaacagactaaaggtggaagttagtttttcatttaaggccaagagcatgttgctgaaaatagcatggcagcagtcaagacaacaaaagaagaaaaggcagaaccggaacaacctaaaatgacgaggcttgcatcaaagtatccgaaactatttaaagtgaataaagaactggaagatcaaaacggtgcaattcaacagaaacaaaaacagctttctgcaaagaagaaagaactgtcagaggtcacgggatggtttaaaggaagaaagaaaaaagaattgcagaaagaaattgatgaactgaaaagtcagatcagagatatgaaagattaccttccaaggattgtacagaaaatcggatatagaagtgtacaggaatttttaaaagattttaaggattctcaatctgagtatagccaatatcgaactgcaatagaaaaatggaagaaagaaacaggaaaagagccagtagcacatggtattagggcgaagctggctgaaaagaaacaagaaatacagaatgaacagaaaaataaacagcatacccgtagtcagaacaaaaatcggggagcaagataggaggacaatcatggagaaacacattatgggagaaaatggaatcagttatactttaggagaggacggtctgtattatccagacctgtacctcccggaagagacagagtatccgattgggaagtatggaatgttgagaaaaacttatttgaaagatcatcggaaaggattatatctggaactggtgcttgccgggaagttgaatgagcatttgcatcagattgacgaggagtgtaatcagatgatggagagactggtggagcagatgaaagaaaagcagggagtgacggaagaactgaagatgcagaatcagatggcatgggttgggagaatgaataatatccgggcatgtgcggaggagattgtggtaaaagaaattgtatattattaaaaagtaggaaaacattttatttatagaaaaattccaataatattagaggaaaattggggaaatattgtagtataataacaagtagtaatcagttgaatcaagtagttgtttgtggtataaattatatgaaacattttaagttgatttgtaagaggtaatatagaatggctagagcaaaaaagaatggaacatatttaaatgtttgcatagaaaattcaatttatgagcaattaaatgaaatatgtgcggatgcaggacaaacaaaaacaattgtggtagaaagggcattaaattcttatttttgcgattacagagaaaagcaaagaaaacttaaagaattgagggaaaaataggatagctgcttttggaagaggacattatcatgaaacatacagtgaaagtagaaaaaacagatcagatatataaatcaggaaattcaatactaaatagtgccaaatattcatcagataatacagatgaatggtatactacgtatgaaactattgaagaggaagtatgtcattataaggaacaatttaaagagaaaattgtattatgtaattgcgatgatccgtatgaatcaaatttttgttattattttttgcgtcactttaatgaattaaatttaagaagattaatatgcacttcatattcgggatcaaaaattgatcaaatcaaagataatgtacaattgtctttaaatttatttgataatttaggagaaccaataaatttaaaaaatggatatgtatttgttatagatgaaatgcctggagagattggagaggaagtaagtgatgatgtaataaaagaagtattgcaaaggaaagggactgttaagagattgtctggttctggagattttcggacggaagagtgtattaaatatatgaaagaatgtgatatctgttgcactaatccgccgtttagtcttttttcagaattgtttgctttattgactaaatatgaaaaaaaatatctgttgataggaaatcaaaatgcaataacttataaagaaatatttccatacattaaagaaaataaagcatgggttggttatagatttggagatatgaaatttcgtgtgccggcggatacaaaacctaggaaaactagattttgggttgatgaaacggggcaaaagtggagaagtttaggaaatgctatgtggttaactaatcttgatatgcgaaaaagacatgaagaattgagattgactaaatgttatcgtccggaagattatcctaaatatgataattacgatgcaattaatgtaaaaaaggttgtggatatccctatggattataatggaataatgggggtgccaataacatatttgaaatatcacaatgagttacaatttgaaataataggcgaagcaaatcatggatcggataatgaatttgatttatttaagccgaaaataaatggaaaagaattattcaagagaatacttataaagaggagaaaagtatgatatcaggattaaatgaatttcgtatacttgatttgttttgtggagcaggcggactttcgtggggaatgcataaaaatccatattttaaaacgatggttgcactggattttgatgagaaagctgttgctacatttaaaaataatatgcctggttcagaagttttggttggagatataacagatgctactgtaaaagaaaaagttgtttctttgtcacgaaaaaaatgtgtaaatatgatagtgggaggcccaccatgtcagggatattctatgaaggggaaaaaacttggattagatgatccgagaaattttttgtttagagaatatttggatttggttgaaaaattgcaaccggatgtatttgtaattgaaaatgtaaaaggactattattatcagcgaatggatggttcaaagacgaaattgtaaaagctgttaagaaattgggatatacaattgagtttgatattcttaatgcggcagattttggagtgccacagtcaagagaaagagctatttttatttgttctaagcatggagcaatttcgttgccaaagcctactgtaaacaaatatgttacagttagagatgctatagaagatttagcatacttagaatctgggcaaggggcgtttgaacaagattatatcaaagaacctaagagtgaatatcaaataaagattagaggtaaaagcacaaaactctataatcataaggcttcaaatcataagcaagtagcaatagacaaattgaagctaattcctccggagcaaggaaaagaatgtttgccagaggaattacatggaaaacagaagtttaaaacaacatgggggagactcaaatgggatactgtttctccaactattgatacaagatttgatgcttcttcaaacggtactaataatcatccatttttgaatagagctataactccgagagaagctgcaagaattcagtcttttgatgatgaatttgttttttggggagctaaagtacatatacgaaaacaaattggaaatgcagttccacctttgttagcagaggcaattgctaacaggattgcggagtattttggtttgaaaaaggagtaaaagaaatgaatacagaaatggcataccttcttggtatgattactggaaatggtgaaatacaacgaggaatgacagcaacaacaatatctattgatgttccacacaaaaagttggaaactgaatttcaaaaagatgtgggaatttatgtaaaggcaagtattacagatattagacaaattttggaaccattgttggggacagcattgaaatttgttcagaatcctaatatttctattctttcatttacgaaacaaaatgaggattacttaatgagagaactattgagatatgtaggttatgcaacttctgcagacaatatcagaatatcaccagaagtatttaattttacaacagatgaaagaaagcagtttgtaaaaggatttgccgatgtaacaggatacattcgtagaagtaattatgcattcaaagagcctaattatagagtatattttgaaattcctaataattgggagttggtagtagattttgcaaatttattaaagagtatagatgtgccagtacaaaatatagattgggcacatccaaatatgagagacggaaatttgacaaaatataaccaagggaagccagacttttggaaaaaagaacatcagattaaagtatgggcggtggaatatcagccaattggatttgcggttattcataaacaagaggcactggattattttgctgataaacagagaattgacatagaggttcaacgaaaaaaacatttatcagatgttactcatagatattattgggaattggtttcacgaaacaggaaaaaaccattacatccaggagaaaatgatgaattcataccgaaggtgattagaggaaaacattatgattcgtggactgctatagcagaagatatgggatataaaaaggattcaatatgttagaaaatgaattatatgaaccgatgcgaggttggcttgagcaatatttgaatgacaaatacaaaggatatgatataattgcagtagatacatctcaggaaagacttgatcgagcattatctagatatggaatagtatatgaggctgcgaatggtgttgacattcagatagatgtattgggaattgcaaggaaaaatgcggatataaaattattttttattgaagcaaaaaaaacaagacttacactgagagatttagggcaattatgggcatattgtaagttaatagatcccgaagaggcttttttattatcgtctgctggtctgggaagcttgagcaagttaatcatttcctttgccagagaggatttgttggattatggatctggaaagaaaattaaaaaaatgagagtggggaaatggaatgtttcgaaaaatacaatagattttggaacattaatcccgaaaatttgaggtgttaaattgatagaaaaattgttaatgcaagagaaaataccatataaagtaattgacgaagataaaggatataagttaattaaaattaattcgaaaatgcatttgttttatatgaatagtcgaagtagtcaatttatgatggagagagattttttcgattatcttgatggaaattccataccgtatgctattttatgtcatgatacatcaaaaaatatattttattatctaaaattaaataaaaaagtaaattggattaaatcatgttttgaaacttgtgataaagaatcaatatatcttggaaaacaggtcttgaatgctagaataaatgaaaaagagttgtatagaactttgagaactttgatataggttggaaggagaagaaagtatgagtattgcacgtgatttagacgaatttattaaaaattcaagagataatgtttttattgaagctgagggtaagccatcaagattaaaaaaattttatacagaatataacgaaatgtatagcccgagtataaataataacacaaatggcattattgttttggaagaagatgcaaataaatggggattagagttaagattgtatttgcattataatccaagttttatcaaagctacgcgaaataaagtatatcgaggcgaatatggatatagaattaatgatgttgatataattaaagatatgtttaaacttggatatcgtattggacttaattaatataaagaaaaatgcagtaaagataatcacagtttgaatgaatgatatgacaaatgtcagaagtgaggtgagagacttgaaatttggtgtggtagatttattttgcggggtgggcggtcttacctgtggattagaaaaagcaggacttgatgttgtagcaggatatgatcttgatgctacatgtgaatatccatatacttataataaccattcactgtttattaataaaaatattgaagaagtaacaggaaaagagattagaaaactactgcgtggatacgatgtgaaaattttagcaggatgtgcaccatgtcaacctttttcgagacaccaaaaagataaaaaagatcgatctaagcataaagattggaaactgttgtatcagtttgcacgattagtagaagaggcgaaaccgcatattgtttcaatggaaaatgtaccagaacttgttaatgaaaaagtgttttgtgattttgtagatacattaaaaagattaaaatataatgtcacttacaatatagtgaatgcagcagattatggtgttcctcaaagaagaaaaaggttattgcttttggcctctaagaaaaaagaaattgtgtttataaaaccgacacatgaacaagtagtaacagtaagagaggcaattggaaatttgccaccaattggggctggagaggaaaatttgattgatcggttacatattacatcaaggttatcggaattgaatttgcaacgtatacaacattctatacctggaggaagttggcacgattggccagaaaatttgatgctagagtgtcataaaaaagaaaaaggtcagacatatacttcagtttatggaagaatgtgttgggaagatgtggcacctactataacaactcaatttacaggatatgggacagggcgttttggacatccagagcaagatcgagcattaacacttagagagggagctataatacagacgtttccggaaaattattcatttttacctgagggtgaagcagttgttataaaagatatatcaaggcagattggaaatgcagttccgccgagattaggtgaaataattggacttagcataaaagaacattatacgaagagaaaatatgtgcgaaaatccgaaagtataaagaaggggggataattttatggaaaataaatttataatgtctcttagcttaaatgtattgaatcatttaggaatcaatctatatagtaatattccagcagtattatctgaaatcgtggcaaattcctgggatgcggatgcgaaaagagttgatattacgattgcagaagaccagattattattgaagatgatggatgtggaatgagtgcggacgatattaataataaatttctttatgttggatatcaaaaaagagaagaatcgttagaatcaaaaatatatcatcgaaaatatatgggaagaaaaggcattggaaagttatcaatgttttcaattgcacgagaagttgaagtaatttcaaaaaaagagattaggaaagcaggagcagagggaaaatgttttgaaataagcggatttaggatgaacattgatgatatagcaaatgtcattaaaagcgaacattcagatagcaatagttcatcagaatattatccggaggtattgcaagtagaagaggattgcattaaagagacaggaactaaaatagtattacgaaaattgaaaaaattgacaacttcgttaactccagaatatattaaaaaacgtgttgcaaggcgatttggtattataggaaaagagtttttattttctgtttatgtaaatggagaagaggtgtctattagtgatagagattattttcataaattgagttatatatggtattttggaaatgaaagccagaagtatgctgatttttgtgaaaatgtatcacataaagaagagagagaaaatatcatttcatgcaacggtgaaaattataaaataacaggttggattggctcggttgatgcatcaggagatctaaaagacggagaagacaatttgaacaaaattgtagttttagttagaggaaaacttggacaagaagatattctttcagagtattcggaagggggattgtactcaaagtatttaattggagaaattaatgcagacttttttgatgatgataccctagacgatatggctactagtaatagacaagaatatagaaaagatgatgaacgctttattgcattaaaacaatttgtgcaagatgaattaaaatatatacagggaaaatggacagagttaagaaatgagtctggagaagaaaaggctagagagctattaccagtaattgatacttggtgcaaaagtctacagggtgatgataaaaaatatgcaaagaaaatgtttggaaaaattaaccagatagtagcagatgacgataagaaaaaagaaatactgaaatttagtgttttagcttttgaaaagttaaaatatgctaaacaccttagtgcaattgacaatattgaggctgagaactttgaagtgtttaaagatatttttactggtttggatgaaatagaagcaacattgtattatcaaataattagagagcgtattgaggtaataaaagtttttcaaagtattacagatgaaaatgctttagaaaaagttatacagacacacttatttaatcatttatggttattagatccatcatgggaacgtgtggagaatacacaatatatggaaactaccgttttaaatgcattaaatagtgagtataatagtttgacatcagaggaaaaggctggaagattagatgttggatatagacaaaccgctggaaagcatattattattgaattaaaaagagctgataggattgtaacgacgagcgaaatgattaagcaggtaaaaaaatatcatgatgcgctaaacaaggtgttgtctgctatatatcagacaaattattcatttgaaatattgtttgttttgggacgtcctattgataataacgatagtatagaaaatcgcgagttggtagcaaatattttaaaaccgatgaatgcgagagtagtatactatcaggaattaattgaaaatgcgtataaagcgtataatgaatatatagcagcaaataaacaatcacagccactgatagatatgttttcacaattagaaagctcaatggatgattaattttttaatttgaaacatcgatactttatttttctgccagatacatcagaaaaaatatagcatttagaaaagtccggagatctatcaagtgcatttaaaacttgctgtattaaattctggggatgtttatgaggaatgtgagatttttttgcacattcctcaattaaatcaagatccccataccatacagttgtcctgttgtgttgtttcataatttcaatcatgttttgggcaattgttgtcttcataataattatatatgttgatgaggaacaatatattcgaaatcagaaaaaaattgtcaaaaagttctctatcagttataatgaagttggcaacatattggcaacagaaaatcagcgagccaaaataatatatgcaatagaaataaaataacggctaaaaagatacaaaacttaaacaaatatatttaagaacatctttggacttgccgaattcgaataatttctaatttgtataaggcattttacgtagcaggtagtcgataagattgcctgctattattttaattatttcatttgctgaaatttaatattataaatgttgtcaataaaaatgtttgattaacactcataatagggtacaatataattagcaaaataaaatatcgcaccggtggtgcgagaaataatgaaaaatggggtatgaaaaatggcaagaggcacaatattttctggagaatcaaaaaatattgaatacaaaatcactttaccagataaaagtgaaaagtacatgaaaacaatcatagcttttgccaatactcagggcggaaagctgattgtaggtatagatgataaaacacacgagattgtgggtgtgacaaacgaaatattatttcagttaatggatggaattgccaatgctatttcagattcttgtatgccgcagattattccggatattgaaccacagacaatagatggaaaaacggttattattgtgtccgtagaagctggaaagaatcgcccatattatctgaaatcaaaaggaaaagagaatggtacctatattcgtgtggcaggtacatccagacaggcatttccagaaaagattagagaacttgaaatggagggggccagaatttcttgggatgaacttacttgtgtaggctatcctgtttcaaaagaggcaacagaaaagctttgtagtaacattgaaaacttccgggaaaaagctggaatgacagaacgttcagtgaagaaagagcagctcattaactggaaaattctgaaacaaagcgaggggcagctattggcaacgaatgcctatgcattattaacttctgattattttccattttctaaaacccaatgtgcggtttttaaaggaacagatcgggcggtatttctggacaagagagaatttacaggaccgatttatacgcagattgaagaggcagtggattttgtactgagaaatataagacttggggcaacaattgatggtttggtgagaaaagaaaaatatgagcttccaccagaggcaatcagagaaatgattatcaatgcacactgtcatcgaaatttattggatgaatcctgcattcaggttgcggtttatgatgatcgactggaagtgacttctccgggcggactgtacaatggactgacatacgaggaagtcatgaacggtcattctaaaatccgaaataaagcaattgccaatatttttagccagatgggactggtagaagcatggggtagtggggtaaaaagaattcttaatgctgcgaaggaatatggacttccagaaccaaaatttcaagaatttgataatatgtttcgagtagaattattccgtaattctttaccgatgacttcagaaaataaacacatcggagaaacatcggagaaacatcggagaaacatcggagaaacatcggagaaacatggaatagttgagcttaatagtactcagcaggaaatagtaaagttacttttggagaataaccagttatcagcagcaaaattagcagaaaagattggcgttgccagtcgaaatatagaaagcaatattaaaaaattaaaagaatttggtattcttgtccgacatggttctcctaaaaatggatattgggaagttacagattgtggggaaaagaacaatgaagataccgaatgatgtcctatcgcatggaaattgtagaagacaaggatgaaggcggtattgcagcagctatgggaagcaccatgccaactacagcaaatcctacagcacagggaatgatctctgtgatatctttcgcagtaaatgtatttatttttgcatacattctgaaacgtgcgaaagctcagaaaaagaatccgtggaaagaagaaatcttcacagacacaagagattatcaggaagcaatggcaagagcaaaataaagagaataaaagaatttagaagaatcctgtacggctgcagtaaaactgtttctgtacaggatttctttgtcttattctaacgcaattatacgtgacaaacatggtggcaatcacgtatactcaaatcatatcagaaagttatggataaaagggtgaaatctatgatattacggaaaagtattttgtcggtcgtgcttaccattgcaatgcttatgccgcttgcacaggctgttacggtgaaggcagcagatgatacaaaacagatagatgtcttgtttactcatgacacgcattcccacctggacagcttttccacgatcgtaaatggagaacaaaaagaagtcggcggatttgcaaaaataaagacactgattaatgaaaaaaagaaagaagatccagatacactcatactggatggcggtgatttttcaatgggaacgctgatccagacggtatatgatactgaggcagcggagcttagaatgcttggatatcttggatatgatgtgactacatttggcaatcatgaattcgactatcgatcccaggggcttgccaacatgcttaaggcagccaaaagctccggagagacactgcctgagatcgtagtgtgcaatgtggattgggacagcatggaaaaggctgggctaaacgacggtcagaaacagatacagtcagcgtttgaaacatatggtgtgaaggactatgtaatggtacagaaaggtgacgtaaagatcgccgttgtaggtgtcttcggaaaagatgccctggaatgcgcaccaacctgtgaattatctttcaaggatcctgttgaggccgttaagaaaacagtagaagaaatcaagaaaaacgaagaagcagacatgatcgcctgtgtttctcatggtggaacctgggaagatgaaagcaagtctgaggacgaactccttgccaaggcggttccggatcttgatctgatcatcagtggacatacacattcagagctgcagaaggcaatccggcacggtaacacatacatcgtgtcctgcggtgaatacggaagaaatcttggctctctttcgatgacgcagaattccgacggacgctggaatctgagcgcttatgagctgattcctgtatctgaggatgtaaaagccgacaaggcaacacaggagcgcatcgacgcattgatggatacggtggatacgaattaccttgcagactttggttatacaagaaaagaagttcttgcgcagaacgatgtggaatttaacagcctggaggaaatgggcacagagcataaagaactgaatcttggggatatcatggcagatgcctacgtatatgctgtggaaaattcagagtattatgatggagacccggtagatgtagcggttgtaccgagtgggactgtacgtgacacgtatacaaagggtgatattaccgtagaagatgtatacaattcattttcacttggaattggcaaagacggagtagccggatatcctctgatcaacgcatacctgacaggaaaagaactgaagctggtggctgaagtggacgcctccatttctgattttatgacgactgcaagattatactgcagtggcctgaattttacatacaacccgcatcgaatgatcctgaataaagtgacagactgctatctgaccagagcagatggagaaaggacagagattgaggatgataagctgtatcatgttgtaacagatctgtacaccggacagatgttaggttctgtaatgaaaatgtcttacggacttctgtctcttgagccaaaggataaagacggaaatccaattgaaaatctggaagatcatgcagtcatggaaggcaataaggagctgaaagcatgggatgcgattgcaagatatatgcagtcttttgatgatgcagatggagacggcattgcaaatgtatctgaatactatgcgacaacccatgatcgtaaggttgtggatgacagcaaaaatatacttgatctggtgaaaaaaccgaataaatttaccgcaatcatagtatgtatcggcctgatcattattataataattgttcttgtggtatccctgattcgaaagatcgtccgcaagtccagaaagaagaaaaatatacataacacaaattattgcggcagtaaaaaacatgaatgatctggaaatctgttgttccctggaggatatccgggaactgatacaggaggaagcagatggtaaaagccataaaagtaatgttgataccaaataacgtgcagaaaactatttgaatcagaccatatctgagatcgtaaatcgaaaaccaagatttatatgtattgaaaatctgaatgtcagcggaatgatgaaaaacagacatttattgttgcaacaaagaatgtagaataatagagaagcaataaaagcgacagaatatagattgtaagactgaatataataaaaaagaccgagaagcttcagaaaataagctttttcggtctttttcataccataagagattgaccaaagttcgtattttattgaattgacacgatatgccaaattacttataattctatcatatgtgtttatgagtaattgtaatatgaatgtgggcagtttaaaaaatctcaggattagagtatgaaaaagaatataaagaacaaaaagagaaaaaatgaccttaggcatttaagcagaaaagaactgatcgatctgatctgtgatatgagaaggccaaatccttcaaaagaagctccgacgatagaagaagctgagaaagaacaaaaaagattaaatcgtcgcgcggcttatcgccagaccttccgcggtacagctgcagtgctgatcgttgtggcagcgatctccgtgcttgtggcgaccttgtggatgccggtcctgcagatctatggttcttccatgtcaccgactctggagcgggggcagatcgtaatctcagtaaagaataagcatctgaaaactggagatatcgttgcattctggcagggcaacaagcttctggtcaaacgagtgatcgcaggtcctgggcagtgggttgatattgatgcaggtggagtggtaacggttgacggccagacgattgatgaaccatatcttaaagaagtgtcacttggaaactgtgatattgagcttccgcatcaggtggcagaatcacactggttctttatgggagacaacagagctacgtcggtcgattcaagaactgcgtccataggagatgtctcagaggatcagattgaagggcagattgtatttcggatctggccattgaatgcggcaggaagtataagataaaaataacagagtgaaagatctggacaataaatgtccgtgttatataaaaaaagtatcgaagggaaagacggaaaagaaaggcatcagatacaccagaaaagagtaggtgaaactgtgcaaaataagggaacagattatatcagaagaatcttaagggataaggcccggcagaaacgttggagacgaataatgctgtgcctttcttgtatagttgttttctgtacaatatatgtactgattcttccggcaataacgctggaaaagaagacgacgtgtgaagaggaacagagcgcgatacaggaagaacaacccctgatacaggaagaggacgaaagcaccgtccaaggtgatggttcagatgaagtagaatttgtatcgtgtgagccgatcgaagaggaaaccgatgacatcgaagatgtcgagatcaccgaagacccggaagaagagacggatgtcgattttgcttcgggagaagaagatgccattgcagtggcagcagacgaggcagtgataccagaggcaggtgccgcagacggatttgatctgagtgcaacagagaatagcagcagacttaaggatgttacgttgttctataaactgcctagtagtgagaactggcaggaattcagtacgactgacaataatactgtgataccggcaaatgcaaagatcaaactgcaggtggagtatcaggaaatacagatcgaaaacctgatgaagacttataattgtaaactgacctataatctcccggagttaatgcgtaatataagaacggaaggtgggatttttgacggaggcaataataaggttggaacggtaacatgtgaaaacagaaaaataacagttatcttcgatgagaattatcttaatggtcttaaaaataatagtcaaaccacaattaacggatatttttatgcacagggcgatgtgaacctgagtgtagtgccagggcagggtggtacgacaactgtaataacaggaaataagacctatcagttgaattttgaaccggatgccgttgcgaagtatggacagataagtgttgataaaacatgtaccagctctcaggtgatatccacagcgagtggagattaccttgcttataccattaccgtgacagcaggtgaagatggatgcccggatgtttcggtggttgatacgatcatgagaagttcagatcgtgtggattcttatgcaggagttagtacgacagcccaaactcttgctgacggtcagaatgggcaaaaaccatatgagacgattgcagaaggtaagagtcatggaagagtacgcactaatgagtcgggaagtatggtctgggaaattggcaacatggcagcatatgagagccgcacgcttacatattatgttaaactgaaggatgatgttaatttaagaaataaagagataaaaaataaagcagctgtgtattccaaaacctatgagagagcttacgatgatacattctttaccccccaaatagcgtatgacatggataaggttcaggttggagactttgtaacaaatgataatggaacatataccatcaaatacaggcttaatttcacgttgaaaaaagacacaagtaattacgcattgaagaattttgagttcagagatttactggatgcgtcggatatacatacggatgaaagcgctcttccatatatcagttatgatcgcaattctgtaaagttatatgtaaaaacagatgaagcttcagattatacttcattatcatccgagacagattacactgtaagctgggcaaaaggcaacgatgactatataacgtcttggaatgattcaaatagtaatccaactcgattcaagattacaggagcaaagggcaagccgataactgtaaatccaggcgattcttactatgtgacttactcagtaacagtgaaatcggaagcgttggcagcaatgaagtcagaccgtgtggaagtgaaaaaccgatattatgcatatgcatcgaatgcaaagcctgactctggaggtgcttttgatcaagtttggcatggagcaaatgtcggaaactataagtgggatgagaaaaaagtcaaaaccggaactgcgacagaccagacgttcacgatgagcggcgataagtatgaatataagtcatctgagtcatctgccaaactggaaaagtccgattctcagacagaaacctcattcaccgtccctgccggaagctacccatataccgtagatgtcaatcagacactgggtgagtgggatgcaacggaggtgtcgatgacggacacactaagttcggataagatgaaatacatcggatatgcaaaagtagaagcctgtgcgtacaattcagatacgaaagaatatgaagtaaaagatacaaaatgggtgaagattgacggcctgagttcgtttgctttgaaaccttcaaatcttggctggacagatgtgaaatatgcatataaatttacctactatgcaaagccggttaacagcaattttagcgaggtaaaggtcactaatacgttctcattgtcaggagatgtgataagaggaaataataggttctcacttgaagggatatcttctcggggagaagtgacagtctccggttcttataaaatgaatgtcaaaaaagaatcctggtattatgaggaacccaaaacagatgcggcaacctggcaaaacggaaaactctactgggtgatcgaagtatcaggaacggcaattatgaagaacacatatttccgggatgctatatcaaaggactcaggtctgacagattcttatctgcactcagattcactggcaggaatttatatgggaacattgccagagggaaagacgattaccgggtacagcagtctggaagaatttgagaaaaatagtggacttgttgatgctaaggataagttcacagcaccaaagttggaaaatagcaagaacttcacaggtactgataattacagtgaactgtcagtaaaggcaaatgaggagattacgcttagagaggataagctttacttcattgtaaggacagaacctcaatcattgccgacaaactatcgtgacgcttttacatacagaaatcatatcagtacaagtgacgatggtaatacctggattgagcaagaccgtgcagataagtttctgtgtggaggcgcagacatcctgaaggaacttggacagacgtttagctacgacggaacaacagtaaccagcaacgctgatggaagggatggaaatagtccggacaaaattgcagccaatggattgagtgaaacgggtgcaggacagtatgcggcctgggcatttaaggtgaactatgcaggtgaattgtcaggaacctatcgagtactggagacaataccgaatggtatggaacttgcatatattcgaattaaatggacaggatcggaacagggaactatttcatcgaaagaaatttcaggaagcgaagtagcaaactggacgaaaaaaacaattacagctgcaacagataataacggcagaatcgagacaacaacgtattatgtcaatggcaatcaggctctgatcgaactgggtgactttaaagcagggaaagaaagggattcctattctgttgacgttcaggttgtatgtagagtgactgatccggatgtactgcttggaggagagaaaaagacatttacaaaccatgttacactccagacagcagatggacaggagatcaatacagcaacctctccggcaaccatagaaccacagaagaaactggacaaacagataaccggcaagaaaagcgaaaaaatatcatttacaatcgaagccaatccacttggcgaggtacttcctgcggagaacggtacgacactgacgttagttgataagctgagtcctacactgattctggatacgggatcaatccgtgtggttaattcaaaaacaaacgaagaggttacttataaagcctcctttgatgcaacaactaatacgctgaaaatagagattccatgtaatgtgtcggttaaggttacttacgatgcgacggtagacgcaccaccggaccagtcagtaagcttctcaaatgaagcatactgggaaaaatattcatcgactggcggagacagtgtgaaggaagaaaattattcctatgccgccggaggaaccgtatcagcaggagataatataactctgaagatcatcaagaaggatcagaacaatctgtcctctttattgatgggagctaaatttgagataatccagtgtaaaagagaaacagatggaaaaattacagatgtatcaggtaagaagtggaccggaacgacaggcgagaatggtgtgattttctttggaacaggatcatctacggattctgtaatggagtacaacactgtttataaagtaactgagaccgaggcaccgtcgggatatgtagtaaaccgtgaacccatctatattatggttccaaggaaagaagaaaatactgcagattattcggattatgtgaatgcatgcataagtgattccaaaattcataagcagtataagtcgatctatgaattgactgtcctcaatcataagggtgagatcacagtggagaagaagttcaagaatgcaggaggtcatgattcaagttcggtgagtggaacatatacgtttggactgtatgagaatgcagatggaacaaacacgacaaactcaacaaatcaagacggaactacatcaaccacaacaccgcttcagacgattaccattacatataatgcagcagagacaggtttcaagacagcgaaattcacgaatctggatctgaaaaagacatattatgtttttgaacttgatgataacggaaatccgattaaagattccgccacagctgcgactgtaaataaaatggaatacttcacatcgtatgagaatccaaagactgcaggtgcaacaacagggggaaacagcgcagtcagtggagatacggtgacagttaccaaccagacccgtgtaaaagaactgccttctacaggcagttatggtccccttattttcaggcttgcaggagcggtattgatatttttcgccggactgcagatgctgattaatataaaaaaaagagcctgtaacaacaggtaatacaaaagagggtgtgctgtaccttccagaaaagtgaattttttttttgggggggggggcagtgacgcaaaaacaaggaggaagaaatgaaactgattaagaaaattgccgccattatgctctctgttatgatggtattgggaatggccagcgtggtaagcgcagaagaaggtggagcaacagctgctacaggaacgggaaagattacgattactaatgcaatagcaggacagacatacaagatatataagctgttagacttagagagttatgataaaaataagggattatattcttataaacctgcagctgaatggaagaaattcttcgaagttggtggtgcgggcaatagctatgtagagattaatgagaatggttatgtgacttggaaaactggagcgaatgcagcaacattagcacaggaagcattggcatatgctaataatacttcaactaatataagtaataatggctccaaatcagttacagagggagaaaactatgtaacatttgacaatcttgctcttggttattatctggtagattcaagcgttggtgcactttgtggtcttaccacaacagataatgaagtaacaattatcgaaaaaaatggtgtacctacagtagaaaagaaagtttatgatggcactaactatagtacttctaactatgctaatattggagattcagtcacgtttttaataaacgtttttgtgaaaaaaggtgcacaaaattacacagtatatgataaaatgtcagatggacttaaattgattgaaagttctgtttcagatataccaacaattcatatagattcttatccggatactgttaaaatagaaacaacagattatacagtaagtattgatgcagataaaaaaggatttcaaattgtatttgataatgattttcttgagaggtataaggaacaagaatatcggattgatattgcatattctgcaaccttaactggtaatgctggaataggaaaaaataatccaaatacaaacaaaacatggctgacatatggcgataataatacaaagagtaccgaatcggtaacaaatacttatacatttggaattccagtatttaaatacacaggtaacgacacacctcttgctgaggcaaaattcacattatattcagattcggattgtagcacggctattgaattaatcaaggcaggaacaggtgaaacgtatcgtagatttattaccaaagacaatgcagtaaataaagtaactgaaataacaacaaatgcttcaggtaagtttaatattacgggacttaattctggaacttattatcttaaggaaattgaagcaccaaagggttacaacaaactgtctgccccaataacagtagtgattgataaagatggagcaatcaaagttaatgattctcaagatgcaacaacagaagtcaaagtcctgaacaacaccggtaccatccttccaaccacaggtggcaatggtacatctctgatctacttcctgggtgcagttcttgcacttgtatccggtgtggtactgatcacaaagcaacgaatgaaaaatagttaaagtaatttcgctgtgcggggaatggttttattccctgtgcagcagcaaggagaggattgtaagatgagaaagcatgtttcaacaattaccacggtgctagtctttcttacaggtctgtccttgttgctgtatccgacagtcagtaactattggaacttcaagcatcagacgcaggcggtcgcagagtattcggaccggattgaaaagatggatgagcaggaaaagaagttggcatttgagcaggcggaaaaatataatgaaacgctgatttcaaatccaggccgttttactccgacggaggagcaggatgagtggtataagagtctcttgaatatagacggaaccggaatgatggggtatatcaccataccggaaatagactgtaagcttgctctttatcacacagtggatgcttcggttttacaggtgggagtcggccatatggaagggtccagcctgccggttggaggcagtggaacgcactgtgttttctccgggcacaggggacttccgagtgcaaagctttttacggatcttgacagactgcagaagggtgatatttttctgcttcatatttatgatcaggtgtttacatatgaagtcgaccagattcatatcgtggaaccgatcgattatggacttctgaacattgaggaaggcgaggatctgtgtacgcttcttacctgtacgccttatggaatcaacacagagagactgctggtgcgcggtcacaggatcgcaaaccggtcgggagataattcgaggatcacatcggatgccgcaaaggtgagtactgtgcttgttgcagtaggcattggaattccgcttcttatcatcagttttattgcagtggacgtgtcggagcgcgttccaaaaagaaaaaagaaaagtaaaaacagaagaagaaaagcaaccatacaaaccagagtaaaacgaatcagaacaaaacaaatcagtgggagaagaagatgaagtaccaatacaggcagagctgttacagtcgaataaagagaatgatatgcatgctggcttttgccgctgttttttccgggatgctgatgaacacaccggttctggctgcggcggaagcagaacagacaaagggaagtatttctcttggatgtccggccgagggtctggagttttcgctgtatcgtgtggcagactacaaagatacaggtggttttgcactgacagaaaaatttcagaattatcgggtttccctggaatcagatgaatggagaggaacagcgcgtacgcttgcggattatgcggaacgtgacggaatccaggcagatgcagtgctgaaatcaggaagtgacaaaaccgtatgctttgaaaatctttcaaatgggctttatctggtaaaaggtcaggcaatcgacttgcaggaaaatggaaaggcaaagatatctgttccgcctgtttcgctgatcgcacttccggatgcttcgcagaaagatccgctacatataaaggtaaacatgaagtatgacgaggaagaaagtgataatatagaagtttcccagacaaagatccatgtgctgaaggtatggaagcaggatcaggcaaaagaacgtccggcttcggtgcaggttgatctgctgagaacagatcaggatggaacaacaacagttgcggacagtcagattctggaaaaggagaatcagtggtcctatacctgggaagatctttcatcacaggtgagttggagcgtggtggaaacagaagtaccgtcaggctatactgtgagtaccagccgagagggaaacaccgttgtgctgacaaacactaaaacagcagattcagaagataaaccagaatcaccagataaaacgggaacgtctggagaaaatggtggaaattcttcacagaagcttccgcagacagggcagctctggtggccgattcctcttcttatgctggccggtgtgatctgtctgttagtaggtaagcagctgcgaaaatccatggaagaaaagaaataaaaagatgcagtataagaaaaagaatcgaattggaaatattttaaaaggagcaggactgattctggtgacagcagcagtgctgctcctggtgtataatctgtgggacggacaccgtgcccgggagagcgaggaggcaatcctggcagaatatctgcaggaaaacaaaaaagcatcagagagtcctgatgcttcggataaagaagatgaacagaacataccggactatcttctgaacccggatatggatatgcctgaatacacgctgagcagtctgggtgatgtggcgtgtataggaattctggagattcctgcgctgaatctggaacttccggttatcagcagctggagttattcttctttaaggctggcaccctgccgttattccggaagcgcctacaagggggatctggtaatcgcagcgcataattatcagtctcattttgggggattaagaactcttccggaaggaagcgaggttttttttacagatgctgtgggaaaccggttttcttactatgtggcggtaacggaggcactgactccctggagtgtggacgatatgacgagcggagagtggccgctcaccctgtttacctgcaccctggacagccagaaccgggtcaccgtgcgttgcgaatacagcgaggcaatggaaaactgggaccggaatgcgtatcggtgaattgcttgctaatgctcatagtccatttttcagtaacacgatctagtactttttaagataaagtagaaatagtgcaattttcacaggatattatacaagaattacatagaaatatatcgtattattgatataatattcttgaattgtatgtgaggagaaaactatggcagctgaaagaaaaacattaacacagttatctgtgccaatatgcttagaaactttattttatatgctttcaggtatggtcgatacgcttatgctatcatctgtaagcgaccaggctgtaggagcagtgggaacagcaaatacatatataggtgtttttattatcatgttcggcgtaatatcgtcgggtatgatagctgttatgtcacaaaatatcggagccggaagaccggggatagcgtatcaggcaagacaacttggacttatattcaacgcattgataggtatcgtaatgtctgtcattcttgctactttttctggtgggatacttcgaatcgtaagtattgctccggctttgcttgagtcggctgaaatatatcttagaattgttggcggcgcatgttttttaaatgcactgattcctattttttccagttatttgagagtgtttggatatacaaaacattctttgataggaactgttgttggaaatgttctcaatataatacttaattcagtattcttatttgtattcaactggggtgtaatgggagttgctgttgccacggttatttcaagagttgtaaatcttgttattgtagcaggtatgggggctgtgcttataaaagcaaaacagagtcctgagcgaattgcatcaagaaagatatttgcgcagattgttaagattggttttccttctgcgcttgaaacagcactttacaacatcgcaatgacctttattgtgcgttttatgaatcagatggatgtggatggaatgaatgttacagcacgctcatatgctgtacagattgcaaatttctcatattgtgtgggagctgcccttgctcaggcaaatgcaattatgactggttggagaattggagcaaaagagtttgaggaatgtaacaggggaacgagaaaagctgcgatatacggtatcatcacagcgacctgtttttccgtgacatttgcattggcaggacattttatcgtgcatatatttactgatgatacacagatgataaatcttgtggtaaagttgttagtagtagatgtttttcttgaatttggaagggtaacaaaccttgtatatggtcaggcattaaaaacgagtggagacgcacttttcccggttatactaggtgcaatatttatgtatttgtttgcagttggcggaacttattttctcggaatacacatgggacttttggctgtaggatcatatattgctatggcaggtgacgaatgtgcgagagctgtgggaatggtacttagatggaagagtggaaaatggaaaagtaaaggtcttatagaagtataggagagattatggaattcgttcagatcaggaagaggcattttttcagtattggagaaaaaacaggctatgaagaaaatatttgggaacggctcagtcatccgatccagtgcctgcagccagaagggactgtacataatacatgcacagtcccttagtgaaattggtttatttctcgcattccagaacaattacttcacagctatcgagcttcagcatttcttctggacaatcggtgcggttctgattggacagaagcactttttttaccagatattcaagtttggtggaaacggcttcgcgaccgaagttggcggcaacgagaatgcgttgtgatttcgtctcacgataatatgccataactgtttcactatcctgatatgcaggaactgttttgccgtaagtaaatacctctttgtattctggagccttgcgggtggcagtcagtttgcggtagtaatttaatacggaatccggatccttttcctgagctgcgacgttgatttctttataatcagagtgaaccttgagccatggtgtgcctgtagtaaatccggcattcgcctgagcattccactgtacaggggttcttgcgttatcacggctcattttgccgcatacttccagagcttctgcatcacttaaacctgcttctcttgcaagattatactgatcgatcgtactgatatcattgtaatcatgaatgtcgttccagatttcattctgcattccgatttcctgtccctgataaatgaacggaattccacggagtaggatgtttacggtaccgagcattttggtgccgacaggcgtttgggcatacttcggaagaaaacgggatacaccgcggggctcatcatgattttcgatgatatttgcttccagtccatatttttggacattgatctgagaactcagaattgtgtcgcgccatgttttgaaatctacatgaggtgcatcgtaccagccatgagcaccatcgctgagggaatgcgcacagaaatcaaagattgtggagaaatgtccgttatctccaataaattgaccaagttcatcagctttcatattgaatacttcaccaacggtgaaagcatcatatttctgaaaagtgtttttcttcagatcttcaaggaattctcctacaccgtcaacgttttcgaccattttccagcaggcggccatgccatccggtccgtccggttcatagtcaggaaaagcaaggtcttttttgatgttgatgatcgcatcgatacggaaaccggcaaggcctttttcaagccaccagttgatcatattgtaaagctcctgacgaagctttgggttctcccagttcagatcaggctgttctttggcgaacatatgaaaatagtatttgtctgttcccggaaccggttcccagcagctgccgccgaagtaagaacgatagttgcttggcgggttaccgttttttcctttccggaaataaaaataatctgcatattcaccatctggatcagccagagctttttggaaccattcatgtttgtcagagcagtggttgatgaccagatccatgatgatatgcatattacgtttttttgcttctgcaagcaattcatcaaactcttccatagttccgaattcttctgcaattgcatagtaatctgaaatatcatatccctgatcgacaaaaggcgatttgtagattggagaaagccagatgatatcaatgcccagtgcttttatgtaatccagtttggaaatgattcctctcagatctccgatgccgtccccgttactgtccagaaaactctttggatagatctgatatgcgattttgtcatgccaccatttttctgtcattatttgtacctcttttattcatgcattatatgtttagtatagatgatattgtgcctgcattcttgcgatatgtcatcattatataatactatcctgcttttggaaaagaaaatatccatctctgccgttctgttttgcacatgtaaatgacaaactcatctccaccgattcttccaatgatatcattttctctgaaataatttcggagtgtctgtccaagtgtgctgaggacaatatcgccgacagcatgcccataatgatcatttacttctttgaatttatcaacatccagaataataaaagtacctttttcatgaggcctctgctccaggatttcgttgatgagtgcctctgtcgtgcgtttgttgagaacacctgtcagaccgtctgtctgtgcatcgtgacgcagctcttcattgcggatacgattgttgtggataatgtagaaaacaagtaacagcaccagaatgaagaatacggacataaaaatgccttcataacttttaatgaaagaataggagctttgggcatcggatacaggaataacatagcagatcatccagtcattcatgccaagccgggtataagcgatatactggtcagattttttgttggagtttgttcggatcttaatcagtccatcgttgccggctgaaaaatcttttttgacatttacaagagaatttttggacagaagtgttctgtctttataaaaatcaaaaaaattgttaccatatgtgattttatgatatgaaggttcaccatcgtaggcgatgatctctccttcttttgtgacaatcagactgtatccggcatcatcaaaaatatcattaaaaagcatctgactaagggcggtcacattataagagccaccaagtgcgccaatgattctgccattacagcgtacaggaacacacaggatcacacgtgtctcctgatcaacactgctgttcagtggatcactgagagttgcctggcctttcatggcttccagaaaatattttctctgggctacattctttatggcaccgttgtcatagtatgctgtaccgtctgcttcgatcagggcagttctttcgaaatccgtgtttgctgccagggataccagaagctccatattttcatcggaaagaatatcagaggaatctcccattttgtcagcgatactgttcagaaatccgtaatgaatattgagaatggataacgcatgatcactttgttttgctacattactggtcatggttttctgagaattggtatcgattgacttctggacatataacagaaaaagacccagactgatgactacggcacagataaaaataataatagcagcaacataatgcgtagaaatattttttttctttttcatattctgtttctcctgtagatagatacagtttgagtatatagagaatatatatagtataaaatattttatgcgagaatgcaaaaacgtttttgcttttttcgccaattaaaaagctcttgactatagcggataagagttgtaaaataaaaaaagcttttaacgaggtaaagcataagagcaaattctatgaagggaatcagtaaaagcagagaaaatagctgtttacagagagccgcagttggtgtgatgcggtaacggcactgttttgaatatcatccctgagaaggaaggccgaacgttacgtttgagatttatcagtaggttttcacggaggctccccgttacaggagacgcgtatgccggtacgttgcagaatcgtacttgtttcaatgacgaaacagggtggttgcggaatgatatatccgtccctgatggggcggattttttttatgcagaattttctgaaaccggaacatcatcatattttacaagggaggaagagaggatgaaagtctacaagaaactcatgaatgcacttgcagcagtagaaaaagttgtactggtagttacaacattgctgattctcgtgctcactgtgggaaacgtgttttcccgtaaagtgatccaccgctcatggtccttcacagaagaacttgttgtagcggtctttgtacttattacacttctggcagcagcattgtcctgcagagagggtggcctggtcagcctgacactggttacagaccgtcttccaaaaaaactgaaaaaaccatctgtgatcctgatcacagtactgagtattattttttcagtgattctttttaagtatggtatggacaaggttatcacccagcttgaaaacggaaaaagaacctttgtactgaactggccggaatggatcttctggtcctttgtaccgatcggagcaggctgtatgattcttcatcttattgagtactgtctggatgtctgttttggaaataaaaacgataaggagggcaaataaatgatcagtgctgttttatttatttcattttttgtttttctgatcctgggtgtgccgatcgcactctgcctgggtctgtcctctgtatgtgcgatcctttattcgggaacctcacttaccatcgttgcaacaaatatgtattcaggaatcagtaaattccttcttcttgcgattccgttctttgtactgtccggaaatatcatggcaaaagccggaatttcacgcagactgatcgattttgtagatacctgtgtcggacacaaaaaaggcggtatcgcaatcgtatgtgttattgtttcctgtttctttggagcaatctctggttccggtccggctacagtagcagctcttggtgctgttctgatcccggcaatggttgagcagggtggtttctctgcaccgttttcaacagctttgatggcaacgtcgagttcggtggctatcgttataccgccaagtatcgctttcgttgtatatgcgtccattacaggtgtgtctatcgcagatatgtttatggcaggtatcgtacctggaatccttatgggtgtggcacttgtaattgtagtaattcttgaagcaaataaacatgatatcaaaccgtcccgtaaaaaagcatctgcaaaggagagatggtccacttttaaagatgcattctggggattcctgatgccgatcatcatccttggcggaatttacggtggtatctttacaccaacagaagctgcggcagtatctgttgtatatggactttttgtaggtatggtgatctaccgtgaggtatccttcagagatctgtttgatatcctggtagattccgcaaagactaccggtggaatcatgctgatcgttgcaagtgcatctctgttttcatttgtatgtaccaagtttggtattgcagaggctgcatccggactgcttgcatccatcgcacacaatcagtttgtatttcttctgatcgtaaatattatcttcctgatcgcaggatgttttattgatgcaaactcagcaatgtacatctttatcccgatcatgcttccggtatgtaaagcattgggatacgacgttgttgcatttggtgttatggcaactgtaaaccttgcgatcggacaggttacccctccggtaggtgtaaacctttttgttgcgatcagtatcaagatcaaaaaaggtctggaggttactcttcagcagatctcaaaggcagttatgccgatgatcgctgccagtgttgcagtgcttctggtcgttacctatgtaccggcagtttctactgcacttccaaaagcgcttgcgaaggatggttcttacacaggcgaacaggtctcatctgacactggaagtactgcttcaaaggatgcaggaaatggtgaagactcttttaatacaattgaagattacagcgaccttgactggccggaaatgacctggaactttgcatgctccacaacggagacaagtacctgggcagacggtggacgtaagttcggcgaactgatggaaaaggcaaccggaggcaaggttaaagttaatgtttatgcaactgaccagctgacaaacggaaatcagtctgaaggaatccaggcactgatgaatggagacccggtacagatttccatgcattccaacctgatctattctgcatttgatccgagattcaatgtagtatctcttccatttatttatgattcttatgatgacgcagatgcaaaatttgacggagcagccggtgaaaaactgaaagaattgctttccgaatatggtctgcactgcatgggtatcgcagagaatggtttccgtgagatcaccaacagcaaacgcgagatcaagactctggatgatatgaagaatcttaagatccgtgtggcaggttccaatcttcttatggaatgctataagagatggggcgcagatgcaacaaacctgaactggacagagacctacacggctctgcagcagaatacagtagaaggacaggagaacccgctgccggcaatcgatgcggcaagtgtgcaggaggttcagccatactgctctatgtgggatgcaatctatgactgtctgttcttctgcatcaaccaggagatttatgacagtctgacaccggagcagcaggcagttgttgacgagtgtggtcagaaagctgttcaatacgagcgttatatcaaccgttccggagatgaagagatcatggagcgctggcagtcaaagaatggcgtgacgatcacaaataaagaagatatggatatcgattccttcaagaaagccgtagatggtgttgatgagtggtttgttaaggaacttgagaaagaaggatacgatgacgcacaggaactggtagatctcttcacacaggaatctacggatacagttgcggattacagtgatctcaactggccggaagcaacctggaactttgcatgctccacaacggagacaagtacctgggcagacggcggacgtaagtttggcgagctgatggaaaaagcaaccggaggcaagatcaaagtcaacatctatgcggcagaccagctgaccaatggaaatcagtctgaaggaatccaggcgctgatgaacggagacccggtacagatttccatgcattccaacctgatctactcagcgtttgatccaagatttaatgttgtatcgttaccatttatttatgattcctatgatgatgcagatgcgaaattcgatggtgaggcaggagaaaagctgaaagaaattctttccagttacggactgcactgcatgggtatcgcagagaacggcttccgtgagctgaccaacagcaagcatgaagtaaaaactctggatgacatgaagaacctcaagatccgtgtagcaggctccaaccttctgatggaatgttacaagagatggggcgcagatgcaacgaacatgaactggtctgaaacttatacggctctgcagcagaatactgtagaaggccaggaaaacccacttccggcaatcgatgcggcaagtgtgcaggaggttcagccatactgctccatgtgggatgcaatctatgactgtctgttcttctgtatcaaccaggatctgtacgatactctgacaccagagcagcaggcagtcgttgatgagtgtggacagaaagctgttgagtatgaacgttacatcaaccgctccggtgatgaagaaatcatgaaccgctggcagtcaaagaatggtgtgacaatcactaaaaaagaggatatggatatcgattccttcaaaaaagccgtagaaggtgtggacgagtggttcgtagaacagctgaaagatgccggatatgacgatggacaggaactggtagatctgtttgaaaaatagaagtcaaaaaatttaaatttttaaattaagaagctggcgcttcgcagattgcggggcgtcagcttttatagtataataaaactaataatggctttttttgaaaaaaggttatgaggaaagtatgtggagattttggaaaaatctataaagtattttacaggagtttaagcggtcgatatgaatgaattcaatctaaatttttataaagggaagaaagttctggtgacaggacataccggatttaaggggacatggctctgcaggatacttcaggagttgggagcggaagtgaccggatattctcagaagccaccgacagatccatcaatattcacgctgacagatctggaaagtcagatccattctgtgatcggagacattcgtgatctggagcatatgatacaggtgtttaaagaaacacagccggagattgtctttcatctggcggcacagccgatcgtaagggaatcttacaaaaatccggtaaatacttatgagacaaatgttatggggacggtcaatgtactggaagcagtaaggcagtgtggaagcgtccgctcttttttgaatgtaacaacagataaagtttataagaataatgaatgggaatgggggtatcgcgaaacggatgaactggatggctacgatccgtattccaatagcaaatcctgctcagaacttgtaacacacagttatgagaaatctttcttgaaagacatggatattgcagtatcaactgcgcgtgccggtaatgtgatcggaggcggtgattttgcagcagaccgtatcattccggactgtgtgcgtgctgtttccggtggaaaaaagattgcagttcggaatccacattctaccagaccatatcagcatgtactggaaccattgggcgcgtatcttctgatcgcggaagaacagtatcaggacagccggaaggcaggatcttataatgtaggaccagatgacagaagctgtctgaccaccggggaacttgcagatctgttctgcacagcatggggaaacggggcagcatgggaaaatctctgtcagggaggtcctcatgaggcaaatttcctcaaactggattgttcccgtattcgaaaccggctgggctggaaacctcgctggcaggtggatgaagcagtagtcaacactgcaaaatggtatcaggcatggcttgccggtcagaatatggcagaatatacggactgtcagatcaaagaatattttggaatataaaaagtataaaaggatagaagaaaagaaaatatgaaaaagaatagagaggttatctgcgcttttgcagcgtgggttttatcggcatgcttttttatgagctgttttatgattccgggactggcagaaaaaatcaacagtctgggaaacagtaacatgcttgtatatggaatgtctctgatcctgttttgtctgctctttgcatctggaatgggaatcgcacacaggcatgaagttgcgggaaaaacttttccggagaatgtcaaagccagaaaaacagtattttggctgatgctgtttatacagattccgttctggctgctttgtatctcaggagagacggaacagcttggatctgtggcggcgaaatacggatggcacacacagccggcagtgatcgcagcatttttgtttttggcagaacttgcaatctttttctgggcatgtcaaaatgtctgctttccggaaaaagacggtgagtggattatccggctggtatatgcagcgttggtgctcctcgttttttacagtatgtacacaccgaatatttttggaagaggagaactgagcgatgcttaccatgggcacgcatatttcaattctgtctacaatatttatcagggaatgccatatacgcataatgttacgagtatttatggacattacggacttttctttaagattccaatggaacttgttcatggtgatttcaaagcctttgttgccatggttgccggaattggagcctttgcacatatctgtgcatttcttatcctggaactgctggtcaaaagccgtgtgttgagggtacttggtgctttggcagttacatttcctgtacttggtatgcgaggtggcttttactggcaggtttggccgcatcgggtaatttttccgatgctgctgtttctgtatggagcatggatcctcaaaaaagagctgtgcaatttctggacagcagtgggtgggtatctgatctgtctgctggcaatcctctggaatacagagaccggactgattcttactgtggcgtgggcaggaatgcttatttcacgtttcctgtctgtgggaaaaataaagatccgtagactattgtggttaagctttgcacagtttgccggaatggccggggcggtgtttggagcgtatggaacagtaaatctctataatatcctgaaacacagtccggcaaattcgtttgaggactttctgatcccattgctgtcaggcagttatatgacgggagttcttcatctggatatgcctacagaacccaatgcatatatggcagtgatcacactgtttctgaccggaacggctctgggaatgaccggctggttcagtggaaaagagagacattgctggcaaaaagaatttttgtttcttctgagtgtcggatcactgggatgtctggtgtattatattaaccgtccggcatatcacaatctggactgtattaccatgccggctgcgatcatggctgcatactgggggcagaagggaatcgaatttatcaaaaatgaagaatggaaaagatttgacagcctttcgctcagacatgtgaccgtcagtggtgtagggctgatctgtatagttgcggttcttgcaatggctaccggaacggttcttcagtttgcacagaacagcaagattaaagaaaattatcataatgtgcaggaatttgaggatttcgcagagcagatcgcagcagttgttcctgagaatacaccgtcatttggtatcaatgttcccgaaatctgcagcatgcttcatcggcggacagaatgttttacaatggatttcagtgatatgctcgttcgctcggacagtttgaaagagctgaaagaccagctggaacatgcggaagtgccaggggcatttaccggaaaatcatccatgaatatctggaaacggaatgatccggaaacatatcggtggttcatggatcattatgaactaaaagagacgattcctttttatggggaaaagtttctgtactatataaaaaaataaaatacagaaggagactattatgtttgaagaaatgacagaacagcaggccagagagcagattctggaaatgacaagaaattattgtgaaaaataccataacaaaaagaaaccatatcagaaaggtgaccgtatcccgtatgcgtccagagtttatgatgcagaagaaatggtaaatcttgtggatagttcccttgaattctggttgaccgcaggacgttatacagatgaatttgaacatgcatttgcaaaatatctcggtgttcgttactgttccctggtaaattccggttcctctgcaaatctgcttgcatttatgacactgacatctccgcttctgaaagaacggcagattcttccgggggatgaagtgatcacagttgcggccggttttccgactacagtttctccgatgatccagtacggtgcggtaccggtatttgttgatgtaacgattccacagtacaatattgatccatctcttctggaagctgcatggtctccaaagacaaaagcggtcatgcttgcgcatacacttggaaatccatttgacctgaaagcagtcagagaattctgtggtcgtcataatctgtggctgatcgaagataactgtgatgcacttggatctgtttatacgatcaacggggaagagaaactgaccggaacgatcggagatatcggaacttccagtttttatccaccgcatcatatgacaatgggagaaggcggcgctgtttatacagatgatccgctcctgaacagaatcgcacgttcgttcagagactggggaagagactgtatttgtgcaccgggacaggataatctctgcggacatcgttttgaccgtcagtatggagaacttccggttgggtatgatcacaaatatgtatactctcattttggatataacctcaaggcaacagatatgcaggctgctgtcggatgtgcgcagctcagaaaattcccgtcttttgtggaaagaagaatccacaactttaattatctgaaagaagcactgaaaggtacagaggataaactgatccttccggaggcatgtgcaaattcaaaaccgagctggtttggattcctgatcacatgcaaggaaggcgtagacagaaacaaactggtacaggagattgaatccagaggtgtacagacacgtatgctgtttgccggtaatctgacaaaacatccatgctttgatcagatgcgtgcttccggaaaaggatatcgtattgcgggaagtctggaaaatacggaccgtattatgaaagataccttctggatcggtgtatatccgggaatgacagatgaaatgctgcaggcgatggcagatgcgatcaaggatgcattaaactgatttacagcagaaagcaggatggaaaataatgattttagatgaaagacttcgctggatggggttctggatgctggacaaaatgaaaggtggaaagaccagagaatattatgaccagattcgttatgcctggaaagaaggcagctctgttgaggagacagagaagagaatccagaatctgatcgcgcatgcagttaagactactgatttttataaagattatccggaaacctgttctcttgaggatcttccggtggtaaataaagataccttccgacagcagtatgaccgttttgtatcttccacatataaagatgcaccagataaccgggtaatgtgtaccagtggatcgacaggaactccactcagaatgatccagaatcgtgacaagatccgtcataatacagcgggtgggatttttctcggagcggcagccggatattatattggaatgaaggaagcatttatccgggtatgggtaaataatgtacgcaaaagcaaatttcagcttctgcaggaaaatctgatcatgatggacagttccagaatggatgaaaaagctctggaagaaatgtttcatgtgatcgagaagaaaaaagtcaaatgtctggtaggatattcttctgcccttggagaactgagtgaatatatcagaaaaacaggaagagactgcagcagatgtgtagtgaaagcaattattccgatttcggagacaatgccggaaccggtaagaagaactctggaaaaacagttcaactgtccggtgcgggcatggtattccaatgaagaaaacggaatcatgggccttcagaacagggaagatgaagggtatcatattgatacagaaacctattattatgagatcctgaagatggattctgatgaaccggcagaacctggagaactgggaagaatcgtgatcacagatctttttaactatgcatttccgatcctgcgttatgacaatggagacacggcagttgcggcccggaaagaaaaaaacggtcgttttaaactttatctttcagaactttacggacgacggagcgacctgatctatgactgtgaaggcaaagcggtcacgccgtatattattaccaataatctgtgggacattcagggagtaaagcagtatcgatttattcaggaagatgtcagagattatacgatctggctgaatggtgatccggaagcaatggatcgggaggaaatcctgcgtcgtattcgaccgtatctgggagaggaagcccgcattaaagtggaaatcgttgatgagattccggtgcttgcttccggaaaaagaaaatacatagaaaaccgatgtgaaaaatatcagcagcataaaggattctgtgggtaaatggcaggaggaaacagtttggaaggcagagaacagaaaaaaggtattgcggtaaataccctgtatacgatgggcggtctgctttttatgaatgcagtgctccagattgtgatcactccgcttcttaacagaatgatgggagcagaacagcttggcggtcttttgtacattacaggacttgttgcgatcatatgtccgtctatcgggcaggctctgaataatagccgtcttgtagtaagacgggattttgatgtgaccaatggggactatgactggcttctgcttggctttggactgatcggaagtattgttgcactgtttatgtccggcaaaagcctggaaagtccgttgatggcagctggcgttttcctgatgtttatgctgactgtattccgctattatggtgatgtggaatatcgtctgaatctgaactaccggagatattttatttactattttttgatcggaatcggatatcttgccggatttggtatatatcgcctgaccggacaatgggtgtggatctatctgatcggtgaagccgcggcactggcttttgtcggtgttaccggaaatatttttcatcagtttttcagaagaagcgaattttttacgacggcactcggtcgaggcttttttcttacgttatcgtatcttattaccaatacgacaatgaatatggatcgccttgtgatcaaacagatcctcggtaatgaacaggtcacacagtattatgttgtttcgctgatcggaaagacgctggtacttctgatcgcgccaattaatacaatcgtgatctcttatcttacaaaaagaaaagaacgactgacgcgttcacagtttggaaaggctgttcttgccggaggcggtgtaagtcttgttttttttgtggcctgtcagatcggaacaccactttttgtgtggctgttttacagaaatctttatgagtcagtaaaagggatcgtaacggttgtgaatcttgcgcagattcttgggctgttttctgcatttttgttcatactcgttctgacgtttacagatgaacggtggcagttgtggattcagcttgcacatttttgtattttgctcgtgtcatcagtacttgcggcacgcacatatggaatgatgggatttgctgttgcttcacttggagccaatagtctccgtgttgcagcagtagtgattctgggtattgtgaaagcaggaaaggataaaggagacagaaatgcagacaggtgaagttttaagaagagaggtatttaatcttcttgacgctgcaaagggcggcagattgaaaaaattaaaagaagtcaataaacatgaaattgttgagggtgtaacagaagattatatggaaagaagagtacagacacttctttcttatgtaaaacagcactctccttattacaaagaacatccggaatggacgaaactggaagattttccggtcatgacaaaaggtgactttatcgaacattatgatgaggtgctggtggattgtgtcagagaacagggaaatctctacaggttcagtaccagtggttctacaggaactccgtttacagtactctgtgacggagataaaatgagccgtgtaaatatgaactttatctcctgcatggaactgaatggctttcgtatgggaatgaaacgtggagaatttcgtgcgtggataaaaggaaaaaatacgatcagtaagtggaaatcttttaaaaataatctgatcatggtggatatttccaatatgggagatgagtcactggataaaatctgccgtgatattgaaaagaagaagattcaggttctggttacgtattccagtgcactgacggcgttgactcagtatattagaaaaacaggaagagatatcagccgctggtctgttgaaatggtattttctatgggagaagcacttccgcaggaaacttatgatctgacaaaagagctgttcggattttctccggtacggtcctatggaaataatgaaaatggctttattgcgatccagcttgatgaggatccggaatatacggttgacctgtataatttttatccggagattctgaaactggattctgatgaaccggcggagccgggagaactgggaagaatcgttgtgacagattattataataaaacatttccaatggttcgttatgataccggtgacacagggaaaatgcgtgtatattatgacaagaacggccgggtgcatgcaaaatatacagagatttacggacgtcgtggttctcttatgtataacacaaaaggtgagccgctatcaatccacgtttttatgaatacactgctgaagttcgaaggaactgtttaccaggcaaaatgcatccagtggggagaaaaagactatgaactgctggtgaatgcggaccgttccagactggacgaaacagaacttctcgcagcataccgacattacctgggtgaagacgcagagcttcggatcacctatgtggaccagattccgattcaggcatccggtaaatttatggtctgtgaaaataaatggaatggaaggaagcaggcataatgaaacagaaagtatcggattatatagcggattatatagcagagtggggaatccgtgatgtgtttaccgtaacaggcggtggtgccatgcatatgaatgatgcttttggacatcatccgaaactgcactgtacttatcagcatcatgaacaggcatgtgccatggctgcagaggcttatgcacgtatggataatcggatggcagcagtctgtgtgacgaccggtcctggtgcaacgaatgccattaccggtgtgctcggcggttggatggattcgattcctatgctggttttttcaggacaggcaagatatgcaactacggttgcagcgtccgggctgaaacttcgaagcatgggagtgcaggaatgtaatattgtaccggttgtgacctcaattacaaaatatgcacagatgatcattcatccggaagatatccggtatcatctggaaaaagccctctatatggcggtgaacggacgaccgggaccggtgtggcttgatattcctctggatgtgcagggggcagtcattgacacagaaaaactgagaggatatgatccacaggagaatccgaaagaaaaaccggcagaaatttcacaggatatcattcagcagattctggacaagatagaaaaaagccatcgcccggttctgtttccgggaaatggagtacgtcttgcaggtgcaatggatgattttcaaaaacttgtaaatattctgggagttccggtgattaccggaatgagcagtgtggatgccatggagtctgaacatccgtattttgccggaagaagcggaggaaccgggacacgtccgggaaattttgcacttcagaacagcgatgtgcttctttctatcgggaatcgccagggatttgcacagaccggttttcagtatcaggactgggcaaggggcagttatacgattctgaatgatattgatgaaaatgaactgaaaaaaccaagtctccatgtcagtcttccagtctgtggtgacgcaggagatctgatacgcaagcttatctgtgcggcaaaacttcggggagcagatgaaacaaatccgttgtttaaaggcagagactggatacgtcagtgtcaggtatggaaacagaaatatccggtggtgacagcgaaacattatgagacggtagaagaaggctgtaccaatatttatgctttttatgaagaactgtcaaaagcaatgcaggaggggcagacactgatggtcagtgtgggaacttccagagtggcaggaagtcaggcatttcgggtaaaaaaaggtcagcgttttattacaaatccaaatactgcgtctatgggattctgtctcccggcagcgaccggaatctgtgtcgcacagcccggaaaaccagtagtctgtgtgaccggtgagggaagtctgcagatgaatttgcaggaattacagacaatatggcagaaccgtcttccggtaaaattatttgtgatcaataaccagggttatcattctatccgacagacacaacagagttattttgaaccaccgctggtgggagttggagtagagagtggagatctgagtttcccggatctgtccaagatcataccggcatatggattttcttatcgggcagtgcatgctgcagaagaacttccggaaacacttcatcaggtcctggaggaaaccggggcatctgtgtgcgaggtgtttgtgacaaaatatcagaaaacagaaccaaaaacctctgcaaaaaaacttccggatggaagtatggtatcggcaccgctggaagatatgtatcctttcctcagcaaagaagaactggaagaaaatatgtttacagaaacgaatggagaaatgcaatgaaacgaatcattgttaccggagcaaccagtatgatcggtacagcattgatcgaagaatgtatcagacatgacattgaggtttatgcagttgtacgtgcagggtcttcgaagacaaaacgtctgccggagagtgcacggatacatcagatagaatgtgaactggaaaaactggaagaacttccggcgaagatcaccggagaatgcgatacgttttttcatattgcatggggaaataccggggaaaatcgaaacagcagtacagagctgcagagcagaaatgtcttttatactctgaaggctgtccgtgctgctcatgcaatgggatgcaaaagatttatcggagcaggttcacaggcagaatatggaccgatggatgttccgcggatcgcaccggacagtccggtacatccgacgacgccttacggtgcgagcaagctcgctgcaaaccagctttctttcatgctttgtaaggaacttggaatagaatggatctggccgagaattttcagtgtgtatggaatatatgaaaaagagacgacaatgatcgcttccggtctgcgcaaaatgctgaaaggcgaaaaaacagagtttacccctgcagaacagagatgggattatctttacagcaaagatgcagggcgcgcatattatctgatcggcgaaaaaggcagagatggtgcagtttactgtgtgggaagcgggcaggcacatcctctgcgggaatatatcatgcagatggcggaacttaccggagcggattcaccgggaatcggcgcgagaccatatccgccgggagcagtgcggaatctgtgtgcagatatagatagtcttacaaaggatactggatttgtaccggaatatacctttgaagaaggaataaaagaaacgctttgctggctggaaagtcagaatacaggagacagaaaataatgagaaagaaaatttcggtggtaattcccacctataacgaagaggcaaatgtggttcctctgtcacaggcgatcatagaggttatggagaaagacctcagtgaatatgattatgagatcctgtttatagacaaccattcaaaagataatacaaaagcgcttcttcgcggactttgtgcaaataacagaaagatcaaggcaatctttaatgcaaaaaatttcggacaggcgagatcaccggtgtatgggatgaaacaggcatatggcgactgtgtggtacgtatgtgtgcagattttcaggatccggtagacatgatccccaaatttgtccgggagtgggaaaagggaacaaagattgtaattggagtgaagagtgcaagtaaggaacgccgtggtatgtacctggtgcgtgaatgctattacagactgatcaacaagattacagatattgatcatattgatcagtttaccggctttggtctgtatgacagaaaatttgtggatgttgtgcgtgatctgcatgatccgatgccgtatcttcgaggcattattgctgagcttggatttgattataaagcgattgaatatacacagccaaagcggcgtgcaggaaaaagcaaaaataatttctacagtctttatgattatgcaatgatcggaattacttcttattctaaagtggtgatgagactggcaacttttgcaggttttatcattgggggactcagcctggtagcagcagtggtctatctggtcctcaaactcatgtactgggatcgcttttcagccggagttgcaccgatggtgatcggtatgtttttcctgggggcattgcagttgttctttatcggacttcttggggaatacgttctgagcattaataccagagttcttgacagaccgcttgtagtggaagaagaacgcctgaattttgacgagccggaggaggacgaggaatgacagatacacagaaaaaaccactgtggaaaaacgaactggtatggctgtttctgctcacaagcggactttttgccattttgtacagtaaatttattctgggtggatatgcctatgtgtttacagatacaggagcagataccatgcagatcaattatgcccagtatggacttttttcttctctgtttcggagtggagaaagtggttatgtgctgcaggcgggactgggaatggatgtatcatcctattatccggcatatctgattccctacaatcttctgatcctgcttgctccgcagagacttcttccatgggctgttcttgcatctgcctatctgaagatgataacgatttcccttgttggatatctgttttacagaaaactgatgcaggatggaatcggaactatggcagcggcgctcgcatggaccttttccggttatgtgattctctggggacagcattacggcttttgtacctgtatggcactgtttacagtctttatgtattttcttcagtgttatctgaatggagaacagcgctggaaaagtgcaggactcgtgctcacggtaacgatgctgctgatctccagttattatttcctgtacatgatcgctttttttgctgtattttatgtctttatttacagtatcatgcagcgatattccctgaaacgtactgttggaaaagtggccggacttggcggcatgggaattcttggtgtactgatcggaggtgtggcactggtaccgatcgcagatacatttctggagagtgccagggcaggggtactggctgcaaaaggaacttctcatttactgagtccatataaaggaaaaacgctgggaacgatcgtggccagatttttttcaaatcatatgctgggaattgacaaagattatacaggatacctcaattattatgagggaatgatacttgcggtcagtatcctgacagtttttgcagtcagctattttattgtaaagaaaagcaccagagtaaaagcactggttcttacggtgtttctggtcttcctgacgatcatgccgcttaccagccgtattctcgtatttacgaaacattcctatcgatggacgtttatgatatgttttgtggaagcacttgttattgggtgtttctttcaggaggtattcagagaaaagaacagaaaaacagttctgaccggcagcatacttgccattgttatctgtggcggattgctggcatggatgtacagctttaaaaatataaaaccggaccataaggttacggcaggagtaataggatttttggcagtctatctgatattatttgcagttggaacttctgtaaaaaaaatgtacagaatttttccggctgctgtattgctggttctgatatgtgagttgtttgttttggattatccgtctctgtggcatcgtgaatctccgaccagaaatcaggtggcaacagaatattacaatgatgggacaaaagaagctgtggctatgctgaaagagcaggatgattcggtataccgtatcgagaaatcctatacatcggcatcagaaaacgatggaatgagtcagggctacaatggactttcggtgtatatgagcaccaatccggcgtcactggttgcttatcataagatgtacggaccggaaacactgtccggtaatttcgtagacttcaatatggatgactatatcaggagttctctgctgggaacgaaatatctgatcacaggaaccggatactatgcacctcagaagatatatacatctgttggagaggcgggtggcagatcagtctttgagaatcagtatgcacttccatttggatatctgtatgataaagaatggaatcaggaagaagtaaaagaaatgtccggactggacaaaacactggcttctctgtctggcttttattatacggatgcagaggagacgccttcttatcagaaggcggaccttccggagcaaacagacctgtcgctgctggattatgcggatacagcgactgactgtacgatggagaaaggatcagaaggcattaccgtgagcaatctcggcgcagatccaaatgttgtatttccaggcgtggcgtcctgttttgcagacaacgacaagttgtatggactttcactgacagtagacgcacctgatgaaacagaaatggctgtttattatcagacagagggagatgaaggcttctctgcggagaaagtttacacatttaaagtcactgaggacaacaggacatgggaacatcttgtacctgggggaatcacagagcttcgtgtagatgtaagttctccggttgaatcagcagtgataaataatttcgaattaaaatcctgcgatattacggaaagtggttatacagcattgaaggaatccggagttgatgaggtgacattttctgacagtacatatcaggcacaggtaacaaacgatgcatctgagaacaaaatgctgtgtgttccgctgttctatcagaagggatggactgcacagatcgatggagaggatgccggtgtgtataatatcaatgaaggtatgtgcggagtggaagttccgtctggaactcatgagattgtattaaaatatgaaacaccataccaaaactatggcgtgggaatgacaatcattggaattataatttttatactggtctttagtcagaatttatataaattttttgtaaagttgtgttaaaattcgttggagtgtgttataatggacgcatagacaacaaaacagttgtttataaaaatatcatccaaaataaacagcaaaggggatgggactatgaaatttattattagtggaaagaacatcacagtttcccagggactcaagaccgcagtagaggataaactcggcaaactggaacggtattttactcctgacacagaagtggtagtaactttaagtgtcgaaaaagaaagacagaaaatcgaagtaacgatcccgatgaaaggaaatatcatcagatccgaacaggtaagcaatgatatgtatgtatccattgacctggttgaagaagttatcgaacgtcagcttcgtaaatacaaaaataaaatcgttgataaacagcaggcagctgcaaacttccagaaagagtatctggataaggattatgaagaagatgaagaggttaagatcatccgtaccaagaaatttggaatcaaacctatgtatccggaagatgcatgcgtacagatggaactcctgggacataactttttcgtattctttaatgcagagactgaacaggtcaatgtagtatacaaacgtaaaggaaacacatacggtttaattgaaccggaattttgattttaaatctgaagtgtagcttggagcacttcatatatgcagtatgaagtcccacccttcaactgaggggtgggacttgtgggtattaaatgtaatagaagcagccggcatcagacaaaagggaaagaagacatgaataacaaaaagaatctcaaaatgaaacccgtaggcagtgaatacatggagcagtataatgcacttcttcgttatgtatttcaggtaactgagcaggagctgagttccattggatggcaggagagagaaattatccgtgccaaatttcctaccatggaaaaggcagatgttataggatggtttgataatgataccctggtttctcaggtggcagtttatccgatgcatgtacggatctttgggcagacttatgcgatgggcggtcttaccggtgtaggaacctacccggaatattccaacatggggctgatgcacaagcttctggaacaggcactcaagaatatgaaggagcgtggacaggatatctgttatctttacccttattccataccgtattacagacgcaaaggctgggaaatcatttctgataagatttcctatgaaatcaaggattatcagctcccgaagaatcatcaggttccgggggatgtccgccgtgtggatacggagggagaagagctgaaagaaacctacaagcgttatgccatgagaacacatggtgcgatccttcgtgatgatctggcatggaatgagtactggttgtgggattctgatgatatcatggcagcagtatattataatgaaaaaaatgagccggatggttatgtgatctactggatcgccaaagaagtatttcatattaaagatatgatctttaataatgaggaggcaaggacaggtctctggaactttgtggcagctcatttttccatgatcaatcaggtagaaggcgatacatatacagatgaaccgctggcattccttctggaagatgcgagtatcaaagaagtgatttctccatattatatgggtaggatcgttgattttgtttccttcattgagaaatatccgtttaaaccaagtgtacttgaccgggaatggaaattccgcctggtcgatccgatcatggaatgtaatcagggaaatttccatctgataatctcaagggatggtcatggacaggttatgcggatcatggagccatgcgaagatacgatcaatattcagacaatgaccactatgctgatgggctacaaacgtccggaatatcttgcaaagattggacgtattcaggcagcagagtggacgattgatatgcttgaggatgcgatcgagcagcagactccgtatatatcagattatttttaaaatatttgaggaactcttgacaatagtatgtgtgcgtgttatattacatatagaacaaaagagatggacaggggatgcggtgaaaataactgcatctcctttttagcaatgtgaaccggaggtggcattatggctaagagagattattatgaagtccttggagtcggaagagatgccgatgccaaggcgatcaaacgtgcatacagaaaacttgcaaaaaaatatcatccggatatgaatcctggtgataaacaggcagaacagaaatttaaagaagttacagaagcttacaatgtattaagtgatacagaaaagaagaaattatacgatcagtatggttttgctgcatttgaagagggcggtggaaatccatatggagccggtggacagaatggggccggaggcggttttcatggaggctttggaggatttgactttggtcagggcggcaatggttatcatgagtatcattttgaaaatagtaatatgggtggtatgggagatattttcggagatatctttggaaatatgttccatggtcagaaaaacagtggatacagtcgtcagagcagtggatttggcggacagggctttcacagtggtttcggaggaagcggatttggagggcatacccaggaaaaaggcagtgacctcaggtctgaagtaagtatcagctttgaagatgctgcatttggatgcgataaaatgatccgtctttcggatccgtcaggaagcggttcccagacactgcaggtacatgttccggcaggtatcgaaaatggcaagagcatccgtctgaagggaaaaggaaatcctggatttaacggaggagaagccggagatcttttgttgaaagtaaatattcagccaaagccaggatacgaacggaatggtatggatgtctatacaacaacagaaattccattcacaacagctgtttttggcggcgaggcaaaagtctctacattgtacggtgatgtgatctgccgtattccggaaggtgctcagacaggaaggaagatccgtctgaagggcaaaggtatcgtttcgatgaaaaatccatctgttcatggtgatcagtatgtgacgattcgaattcaggtgccacagaacctcagcccggaagcaaaagaaaagttaagagaatttcagcaggtctgcagaaatgatgaacggaaaagaagaggaagcgtagcataaagacgcttcctttttaaaattatttataaaacaactatgaaatttttgtaaaactgtccattttcggcattttgtgcattgattatttgataggatagagatatcataagctacagaaaaaacagaagtccaatgacagcagagttttgctatgaacagtaacagacaggctgtagccggaaaggatggatattttgaattatctgaaacaatcaaagcatttgtggatcatacctgcttatggaattttttatatgatctcgtttatgctgatggagcagagcgatgtaaaaatacatatgattcattcattagctgatgataagattccgttttgcccgtattttattattccatatgtactctggtactttttcctgatcggaacagtgatttattttgcggtattctgcccgagcaaaaaagaatattatcaatatctcggaactctgggtgtaggtatgacactgtttctgctgatctcttatgtatatccgaacggacagcatctgagaccggatcttggcagtaccggaggcggtgtgtttatcagtgtgatacgttttttgtataaaattgatacacctaccaatattttcccaagcatgcatgtatttaatgcaacagcaagctgtatcgccttatatcaaaatgaacggtgcaggaaaaataaattgttcacggtaagtcagatcatacttacaatatcgatcgttttatcaacgatgttcctgaaacagcacagtgtggcagatgttatgactgcactgatcctgaatattctttgttatcagctgttttacagagtgcttcctgcaagaaaggaacgcctggcagaagtacttacacgcagagagatctgtacggttccgaatctgctcagcacacttcgactgtgtctggcagttgtattctttggaatatttgagagatatggtgtaggagagtaccgtacggtacttgtactgctcattcttgccgctgcggcaacagatgttctggacggcagaattgccagatcctttaacagtatcagccaggtcggacgtattctggatccggtggcagataaggctatgcagggtgtgatgattgcgtatctgattccaagatatccactggcgaagcttgtgctgatcctgtttgtgataaaagagtgttatatgacagttgcagggtggaaagtactgatggagacaaaagaaacgattgaggcacaatggcatggtaagctgaatacagcagtaacttatgtagttgtactgatcctgttggcaggaccgagacttccatattctacatctaatgtactgattggagcctgtgcagtctgcatggcaatgtctctgagtatgtatgcagcgcagtttcgcgaaatgctggaacaccagaatggaagatatcagcggaaaatgcagggcggtttcagtggtaattaaaagaaagattaatttaaggaaggggtttcctcagaggggagaccaccttccttttttgtcagactgtccttataacagaatcaatttcctggagaagattctgccgttcttcctgaaatttcagctttttattgaaacgaaaatattcttcacagccaaaatgactaatgaaagatactgcatttgcgttatgactgagatctgagatcagaaacaaaatttcaggtccatcaccaaaagccgactcagcaaaagaaaagccaagatgcagcgccagagaagtgcggtttacagtatcctgtcggatcttgacattttcctccagagcgtgacgcaggatcgcgattacttcttccggagcagaaatacgttcctgctgagtgcgggagagactttgctcaagaattcgggcaatacgttccgtgcagtctgtttccatgcggttaagcagatggttttccaggcggattttttgagaagttcgatattgttctgtaaaagcagcaagcgtatttccttcaagaagtgaggctctggcctgacggagtacgctctgaagggcgactgcgaactggtcttcttcccggaatttcagaaataaggtgttccatccatccagaagaagcccggcaacagtaagacgttcatctgttggggcatgggctgctagcgtgcagagtgactctacaacggattcatcaagggatccggagagaatttcaggaatccggtaatcctgacgatattttgcgtaaagctggtaataagcaccaaaatctcttgcaatctcttcatcctgcagatactgacggatcaggttttcatccggagcaaaatgcatatcctcatatccgtataaaattgcagaaagatcttcccagccacgtgcagtgacgaaacagatgcggtccgccgtattctcaatatggtaaaaatgttctctttttaaactcaggtaagaaagaacagaaggatgaagcccttttgcagatgcatattctttccatacattgagatctggttcaatatcgattcgttttacgcggtccagagtgacaatatcaaattctctggcagatttattgtattcaacaggatttccggcggcagcaatgatccagccggatggaaccggatgggtaccaaatgttttattttgcagaaactgcagcatagtgggaaccagcgtttcggatacacagttgatctcatcgataaaaaggattccttctttacagccggtttcttctatcttttcataaacagaagcaatgatctcgctcatggtgtattctgttacggaatattcttttccctgaaaattcttttttacaatgacagggagaccgacagcactctggcgtgtatgatgtgtaattgtataagcaaccagtccgattccacattctctggcggcctgttccatgatcgctgttttgccgataccgggcggcccgatcaggagaatcggtcgttgtctgacagatggcaggagataatggccattagaatctttacgcgtatagacttgtatggtttggagaagttcctgttttgcttctttgatattcataaaatgtggtatcctttctgcatctgagatgatgcaagattatgtttcatccatatataacttatgtgcccagaccggaactttctgatgcagggccttttcacggtaaaaaataaaagcagtctgataatctgtcggtctttcgggataaataccatctccgtctgtgaagtacaaaagtcctttcagattacggagagctccggtgttacggagatcctgcacatatgcaaaaacaggacggaaatctgtgccgccacgaccgtggatcgtgatatgtgtcagataatttttccagtcatcttcgcaggtaacatgtataacgtcctgaataaagctgtcacactgaatgatgtaaaggttcattttgcggaaaaaattttcgtgatcactgagaatcccataagtctcttccataaaacgccggactgtagcggcggagcaggaaccggaagtatcgatcgcaatgacgagttcttccatgcggtttacctcctggtattccagatgttcaatgagtggcatattgccataatgttccagaccatagagataaggaatatagtcaaaactttctgtatctgtatgaagttcctcgcggtgaacggcaaaatgtctgagaaaacgatgaaaatcatagcggcgtttttctcgcagactgatttcttcctgcagactccccggggaagcgcctctgccgtcagaaccgtagagaccgaaaccaccggtaccataactgttgttccagagatttttcatctgttcgagaagcttcttacggtcagcctttttccagaactgatgatcatccattgcacaggcttccggtaactcaggactctgcgaataaagtatagccggacgatattcttttttctcatgacagatcagtcgatatacagcaaggtcgcaggcccggttccatcgctgaacgtcagaaggtatctccaggatcagatgaagaaaaagacagtgatacagcatgtgcaaaaaaagtttttcgagagtatcgggatcatcctgaaacgtttttatgagaaaatccggacagaaatagatgaccctgccatctgtgccggcagaggatgtttctgaggattcctgaaaggaaaaattccagagaagacgacgaaaaaagggatatctgacagaaagctgttcacgtacaaaattccatattttttcataaagaccggaggtgtccggagaaataggatgtttcataatcttactccttatttgtatcagaaggtaaagtcatggtcatgaaagccaaagtggtctttttggaattccagaaagaaggaaagaatttcttcccggtggagccggacggcttcctcaataaatgtgtcgagtgcggattctgtgatcgatacaaactgacagagtttctgaatacgaaaaaaatcatcctgacggatcagttcgattatggcaggccggaaacgaagggaaagataatgctgatatttttctttccatacaggatcctgaacttccgtaaaacgttttaatgcaatagcaagacgcctggcttcctgaccggcagattcaaattctttttcgcagctgtccatgaagaatgctcctttcaaaaatagtgaataattatttaaccgaatcaagtaagttccctgcttcaattgcgaatatccgcttgaccagttgaaagttactaaaaaggattaaattcagtgtatcatttcggtgggagttgtcaatggaaaagaaataaggtataatcaccatagttgtatgacagtgatataattctaaagagaatgataatggaggaaaacatggaaaacgtatttattatggatcatccgctgatccagcacaaaatttctatgcttcgtaacaaaaatacaggaacaaatgagttccgtaaactgatcgaagaaattgcagtccttatgggatatgaggcactgagagatcttccactggaggatgtggaaattgaaactccgatcgagaaatgtaaatccccaatgatcgccggaaagaagctggcagttgtgccggtacttcgtgccggacttggtatggtaaacggtatcacaacgctggttccgtctgcaaagatcggtcatatcggcctttacagagatccggagacacatgaaccacatgaatattactgcaaacttccggatccgatcgaacagagactgatcgtgctgacagacccgatgcttgcaaccggtggttctgcggtagatgcagtcagaatgatcaagcagcatggtggaaagaatattaaatgtatgtttgtcatcgcagcaccggaaggtctggaacgacttcacagagaacatccggacgtgcagatctatgtaggacatctggatcgtgaactgaatgaaaatgcttacatctgcccgggactcggtgatgcaggtgaccgtattttcggaacaatctaagagacatcggagaagcagaaaataatgaaaaaagaagaactggcactggaagtgatcgcccggctgaaaaaagaatatccggatgcaggctgtacactggattatgatcaggcatggaaactgcttgtgagtgtccgtcttgcagcgcaatgtacagatgcaagagttaacgtagttgtagaggagctttatgcgaagtatccggatgtggcatcgctggcggctgcagagccggaggagatcgaggagatcgtccggccgtgtggacttggcagaagcaaagccagggacatcagtgcatgtatgagaatccttcatgaacagtatgatgacaacatcccgacaactttcgaggcacttttgaaacttcccggcgtaggacgcaagagtgccaatctgatcatgggagatgtttttggcaaaccggcaattgttacagatacgcattgcatccggctttgtaatcgaatcgggcttgtggatggaatcaaagaaccaaagaaggtggaaatggccctgtggaagatcattccaccggaagaaggaagtgatttctgccatcgccttgtgtaccatggacgtgaggtgtgtacagcaagaacaaaaccgtattgtgacagatgctgtctggaagacatctgcgcgaaaaatatataatgatctaatcggctcctcaggatatgaggagctgattctttaagaaaaggagaattctgtgatatgaaatatgcaatcatcggagctggcggaaccggcggaagtcttggcttttttctgacgaaggcaggaaaagatgtaaccctcatcgccagaggaaaacaccttgaggcgatcagaaaaaatggtctgggcatggaacgcctgtgggatcataaaagagaaatgattccggtaaaagcatgcacagtggaagaatacagtgatacacctgatgtgatcctggtctgtgtaaaaggttattctatgacggaaacaattccggtgatccggaaacttgcaggaaaagatacagtagtccttccaatcctcaatatttatgggacaggaggaaaacttcagaaagaatttccggaactgacagtgccggatggatgtatctacgtatctgccaatattctggagccgggtgtgatcctgcgacatggaaaaattctccgtgttgtcttcggtgcgagaaaaccggaagaagagacggaaaagatgcgtgaaattgcaaaagatatggcatgtgaaaatatagaagtgattctctctgaagatattcgcagagatgctatggtaaaattctcttacgtatcgccgatcggagtagccggactttactgtaatgcgacagcagcagattttcagaaagacggagaggcaagagaaatgtttaaagctctgatcactgagatcgtagcgctgtcccatgcgatgggaattgaatttcaggaggatcttgtggagcgaaatctgaagattgtggcaccactggcaccggaggcaaccacctctatgcagagagatgtgtatgcgggcaaaaaatcagaaatagatggtcttgtatatgaaatcgtccgtctgggaaaagaatatggtgtcccacttccggaatacgaaaaagcggcggcacgttttcatgaacagggactcaaataaacgaaggaagtgataaaatgcggaaaatgaagagggtggaagattcccgcactgaaaatacctatctgatcatgaataagcatatcaacagctatggacgtctgtttggtggtgtcctcatgcagtggattgatgaaatggccgggattgtggctcaccgccatgcaggaacgatcgtcacaacagcctgcgtggacaatctgaactttaaggcaggcgcttatcttggaaatactgttgtcctgatcggaaagatgacatacgtgggaagaacatccatggaagtacggatcgatacatatgtggaagattctgacggtatgcgcaagatgatcaaccgtgcatatgaagttatggtggcgctcgatgaaaacgacaacaaagtcgaagtaccgggtctgatcgttgagacagaggctgaaaaggcagaatggcagggtgcggaaaaacgttatgcactccgaaagaaaagaaggattgaaggattctgagaaattttctgataggaatgttacaggagaaaacagatggcaaaaagaattggcatcatatctgatacacacggattgctgagaccggaagtgatcagcatacttaagacatgtgactgcattttacatgcaggagatgttgaccggccggaaatccttgaccagctccggtatcttggcagtctttatgtcgtgcgtggaaataatgaccgtgactgggccgaaaagctttcagttacactgcgatttaaaatagaaggaacggaattctttatgacacataataaaaaagatgttgcatgggatctgggaacagcgcaggttgttattttcggacacagtcatcattattttgaaaaaatgatcgatggacggctgtggttgaatccgggaagctgtggcaggagtcgttttggcggagaagtcaccatggctcttatggaaatcgacaatggaaactggaatgtcagaaaaatcaatttttctgcataaaaacgaacatatatttgcttttggatgatttgtcccgttttatcgtacattaaatatgagatactcccaatataagaaacaaatgttcggaaaacatgttcggtataaagggaggaaaccacgatggtcaacacagcaaatgcagaaggaagagtttacagggcagagagaagtcacggaaagaagaatcgcaggaaattttccagtatcatggcgatggtattaggggcgatcgttacaatagagatcatgatcatgggtgcgatggttttgaaactggattttcattctgcagacaggattgccctggcacttggctttatggtattatattcaggtgtagtcatagcattggcagataaataagggagaatgtatgccgagatcatttaatcagaaactcaaaattttatatctgatgaaggcatttgaagagaagacggacagagaacatccgatatccgtagctgagatcataaaatatatggacagttatggaatcagtgtggagcgtaaggctgtctacgatgatatagagacactgagggtgttcggaatgaagattgagaatcgaagaggacgtccttcgggatatttccttgcggacagaaagtttgaacttccggaattgaagattctgatggacgcagtgcagtcatccagattcctgacgcagaaacagtcccgggaacttctacgcaaactggaaagtctgaccagtgccagtgaagcgaggaaacttcagtatcagacttatacagtaccgggagtgaagtcaccgaacaatgaagtatatcagaatattcaggggatttatgatgcaattgcggagaaccatcagatcggtttcctgtattatgaatgggatttttctaagaatctgaaacagaaacgcggtggagaaaaatacagagtaagtccgtggaaattaatctggaagaacgaaaattattatttgctgggtatggacgagaaaagtgagatcgtcaaacattatcgtgttgacaagatcaaacatctgaatattgagaaagctaaaagaaatggagagagcatttttcaaaattttgatatggagaaattttcagccggaacttttggaatgtttggaggaaaagaaactcctgtccggatggaatttgaaaaccgttttgttggtgtggtcctggatcgttttggacaggatgtcatgctgattccccgggatgaaaagcatttttcgatgcagacgcacatcagtgtcagtccgaaattctttggctggctggccagccttggaacaggggcggtgatcatatcaccggagaatgtacgcagagaatatatatcatttatgaagaatactctgatgaattatggagaagaatagaatatgaccgttaaatcaagacttttggaaattctggagaaagagaagggtgagaccctttcaggagaaaagttagccgaggagcttcactgtaccagggctgcaatctggaaagctgtgaaatctcttcgggaagaaggatacatgatagaggcgggaccaaataaaggctatatgctggtgaaagcgaatgatcgactttccgttgaagcaatacggccttttttgtcgtttccggaggtttatatcaaagtttatcaggaagtggattctacgaaccgtgcagcgaaagcggctgctattaccggagaagccggtcatggaagctttgtgctggcgggatgccagacagaaggacgtggccggcggggacgcagtttttattcaccgcaggatgcaggaatctacctgagtgtgatcctcgaaccgaaaggcagtcttcaggagagtctgcttctgactgcagaggcggcagtggcagtttacagagcagtaaagaaaattaccggagttgaactggatattaagtgggttaatgacctttatcataatggaaaaaaagtctgcggcattcttacagaagcagtcacagactttgagagtggaaatattgaatttgccgtggtcggaatcgggttgaatatttttgaggcagcggacgggtacccggattcgttaaaaggaattgccggtggaatatatgagaaccgggaagctgcgggagagcttgaccgcagccgactgaccgcagagattgtgaatgccctgcttgaggaaaccagagaactgagacttccgcaggaatatatagaacataatcttgtgcccggaagggaaatctgtatttcggacggagataagatccgcagagcgaaagcactggaaatatgcccggatggaagactgaaggtagaggaagcagacggttccttgtcggttctgtcctatggagaagtatcaattataatatgaagttatattaaatataattgtgaaatgtgcataattttgcattccattttgagacaaaatagggagaatggatattgacttttttttgacaaagagcgtaaaataagtgcaacaaagacagaccggtcataccaatttaatgacaatccggtcgagagaaaaggagggagaaagacgggaaatttatcagccacactggcagaagagctggaaagcaagactgcctttacgataccggtgtttggcggagtgccgatctcagagagtgtagttgttacatgggtgatcatggcagtgctgttagtactttcactgatactggttcgtaatctcaaggttgagaatccaggcaagaaacagcttcttctggaatcaggagtaagttttctcttgaatttctttgaaggaattcttggagaagagggaaaaagatatatcccttatctgatgtctaccgttatctatattggaattgccaatatagcaggtgtctttggtttcacaccacctaccaaggatatgaatgtgaccatagcactttcgctcatgagcattattctgatcgagtactctggttttcataaacgaggactcaaaggatttctgcatagttttgcagaaccggttccgatcatgcttccgatcaacattctggaactggcgatcaggccgacatcattgtgtatgcgattatttggtaatgtcctgggaagtttcgtagtaatgaaattgcttgagtttatatgtccggcaattcttcccataccattcagcctgtactttgatttctttgacggattcatccaggcatatgtattcgtattcttaacatcgctgtttatcaaggaagcaattgaataatcaggataaacagatatcaaattaagaaaattcattatttttgtcaatcgaggaggaaaaaattatgtcaacattagtagcaatcggagcagcaatcgcagttcttacaggtatcggagctggtatcggtatcggcctcgcaacttcaaaagcagtagaagcaatcgcaagacagcctgaagcagagagtaagatcagtaagaaccttctgttaggatgtgcacttgccgaggcaacagctatctacggtttcgtaatcggtcttctgatcatcatcatgctgggctaatagaaaagatatagacaatgagaatgaatcaggataagagaggcaggtggaccaggtgataaagattgatatcaaccttgtcttcacaatcatcaacctgttggttctgtatcttttgatgaagaagtttttattcggaccgatcataaatgtgatggaccagagaaaagcgatgatcgaccagcagtttgcagaagcaaaggaacgacaggataatgcaaaagcacttcaggaacagtatgagggtgctttaaaatctgcaaaagaagaatcctaccagatcatggaacaggccagaaaagaagcaaaagctcaggcagaccatacagtagaagagacaaccgcaaaagtagatgccatgcttgcaaaggcacaggaagacatccgtatggaacgcgagaatgcaatgcgtcagatgaaaggcgatgttgcagagcttgctatgaaagctgcagctaagatcattggtaaggacagtggagcagatcaggatttatccttatatgatcaatttatagaagaagcaggtgatccggatgacagcgaccgccgttaattatgcaaaaacactgtacgagctttctgtttcgacagaagccgtacagacaacaaaagaaatattccgtgaggttccggggctggcagagagccttgagaacccactggtgccttttgaagcaaagagcagagtgatcgacagagtgatccctgatgagatgaagaatttcattaaggttgcctgcagacacagaaacatcggtcttctgaatgagatctttgaaaattatgaagaaatctgcagaagacataagaacatcctgcatgcagtgatgcgttatgtaacaccgccgaaggatgaacagctgaaaggcatcaaagcatttttgtgccgggaatttcaggctgaacaggccgaaatagagatgatagaagacaaaagtctgatcggaggatttgtcctccaggcagacggacgtgaatttgactggagcatgcggggacgttaccgtatgttacaacagaaactgacccggaggtgaacacgttgagtgcaatcaacccagatgagattatttctattctaaaagaagaaatagaaaattatgatgagatcagccagaaccaggaagtgggaacggttatttctgtaggtgacggaattgcgactgtctatggaattgaccatgccatgtatggtgaggttgtagtatttgaaaacggactcaagggaatggttcaggatatccgtacaaacagcatgggatgcatcctgtttggtaaagataccggaatcaaagagggaaccaaagtaaccagaaccggaaaacaggcaggtattcctgttggtaatggatatgtaggaagaatcgtaaatgcccttggtgctccgatagatggaaaaggcgagatcaaagaagaaggatatcgcccggtagagaatcctgcaccaggaatcatcgaccgtaaatccgtaactgtaccgctggaaacaggtatcctttctctggattccatgttcccgattggccgtggacagcgtgagctgatcatcggtgacagacagaccggtaagacttcactcgcaatcgacacgatcctgaaccagaagggaaaggatgtaatttgtatttatgtagcaatcggacagaaggcatctaccgttgcaaaggttgtatccaacctcgaaaaatacggtgcgatggagtacacaacagtattctcctcaacagccagtgactgtgcaccgcttcagtacattgcaccttatgcaggaacagcacttgctgagttctttatgtatcagggaaaagatgtgctgatcgtatatgatgacctttctaaacacgcagtagcatatcgagcactgtccctgttactggaacgttctccgggacgtgaggcatatcctggtgatgtgttctacctgcattccagacttctggagagatccagccgtctgagcgatgaaaagggaggcggttctattacagctcttccgatcatcgagacacaggcaggtgatgtatctgcatatattccgaccaacgtaatttctattacagatggtcagattttcctggagagcgacctgttcttctccggtatgagaccggccgtaaacgtcggactttctgtatcacgagttggtggtgcagcccagacaaaggcaatgaaaaaagcatccggaagtgttcgtatcgatcttgctcagtaccgtgagatggaagtcttcacacagttcagttctgatctggatgaagcaacaaaggcacagctggcatacggcggatgcctgatggaacttctgaaacagccgctgtgtaatccacttgcacttcacgaacaggtaattacattgtggacagcaactcataaaaaaatggttcatgtggataaaaagaatgtgaaacagtatcagaaagatcttctggcatacttcgataatgtttacccggaaatcggtaaagaaatcgaagagaccaaggtactcagtgatgaactgggagaaaagatccttcaggttgcagatgagttcagggatcgtgcagctaccaaataaattatttgtaaagaatgcgattactgtgaaatgacaagtttgtcagagacagtaaccggcaggaggaatttatggcaaatgcaagagaaataaagagcaggataagcagtgtccaggacacaatgaaaattaccaatgccatgtatatgatttcctcttccaaaatgaaaaaagccaaaaagatactgtcggataccgagccgtatttctacaatatgcagagtgcgatcgcacgtatcctccgacatatcccggatatacagcatccgtttttcagtgtccgccacctgattcctacagaggaacgtaagattgcgacgattgtggtaacaggtgataagggtatggcaggtgcctataaccacaatattaccaagatgacagaggaatttatggccaatactcctggccaccataaactgtatgtccttggtgttgtaggaagacagtatttcagtaaaaaagatgtcgatatggatggaagcttccgttatactgtacagaagccaaccatgcacagggcaagaatgatcagtgaggaagttataagaggctttctggaaagagaagtggacgaggtgcatatcatctatacacagatgcagaatgcagttgtgatggaaccggtaaatatgcagcttcttcctttaaaaaagaccagcttttcaccgcttgagatgccggcagaagttcatcaggaagaaatcgaaatgtttccttccgcagatggcgtgctggatatcatgattccaaactatctgacaggtgtgatctatggatgtctggttgaagcatatgccagtgagcacaatgccagaatgaccgctatgcagtcatctacggacagtgcaaagaaaatgcttcaggatctgtcgattcagtataaccgggcacgtcaggcagcgatcacacaggagatcacagaggtttgtagcggtgcaaaggcccagaaaaggaagtgacgagaatgagtaaaggtaagatcgtacaggtcatgggacctgttgtagatgttgtttttgaagatggagatctgccggatatcaaagatgctcttgaagttgaaaacaacggtaaaaaatgtgttatggaagtttctcagcatctgggaaatgatgtggttcgatgcatcatgctgagtgccagtgagggacttcagagagacagagaagtaattgctacaggaagtggaatcaaagttcctgtaggtgactgtactctgggaagactgttcaacgttctcggggagacagtagatggtggagaatctctggatgatgcagagcattgggtaatccacagagatccgccgagttttgaagaacagaaaccggcagttgagatcctggaaacaggaatcaaagtcatcgaccttcttgctccttacgcaaagggtggtaagatcggtctgtttggtggtgccggtgttggtaagacagtcctgattcaggagctgatccagaatatcgctaccgagcatggtggatattctattttcaccggtgttggtgaacgttcccgtgagggtaatgacctttggagtgaaatgaaagaatccggcgtacttaagaaaacagccttagtgttcggacagatgaacgagccgccgggatcccgtatgcgtgttgcggaaacaggtcttactatggcagaatatttccgtgatacagaacatagagatgtccttcttttcattgataatatcttccgttttgtacaggcaggttccgaggtatccgcacttcttggacgtatgccttccgcagtaggttaccagccgactctggctacagagatgggtgaactgcaggagcgtatcgcatccacaacatccggatccgttacttctgtacaggcagtttatgtaccggccgatgacctgactgacccggcaccggcaacaacattcgcacatctggatgcaacgacagttctttcccgtaagatcgttgagcagggtatttacccggccgtagatccactggaatctacatcccgtattcttgaagcagatgttgtaggtgaagagcattacgaagtagcacgccgtgtacaggaaatccttcagaaatacaaagagctgcaggacatcattgcaatccttggtatggaagagctctctgacgaagataaaaatactgtattccgtgcaagaaagatccagaaattcctttctcagccgttccatgtagctgagaacttcacaggtattcctggaaaatatgttccgcttaaagaaacaatccgtggattcaagatgatcatcgatggtgagatggatgaatatccggaaaacgcattcttcaatgtaggaactatagacgaagtagttgaaaaagcaaaaactctggaacagtaaggagtgaggcttatgcagaatacattcggtcttgagatatacgctgcaaacagacagttcttttccggaagagcgcagtcactgatcataccggcggaagatggacagaaagaatttcttgctcatcatgcgaatatgatctgtgccattgttccgggagagcttcgttttcaggatgcgaaaggaaattgggagacagtggcagtgagttccgggtttgtagagatgatcaacaaccgtgcaaaactgttctgtctgacggtagaacgtccggaggaaatcgacatccgaagagctgaagaggctcgtgatcgtgctgaagagcagctccgtcagcagcagagtattgtagaatatcacagaagtcaggctgcgcttgcaagagccatgacccggctccgtgtaacaaaagaattaaaatgatatcagggttccaaaggccataaatagagttaaaaagagaattgctattatatagtgattctctttttttgacgaaaaaacgaaaatggctccatatatagcgcattatgttaattgtaaagaaaatttggctgtgttatactctcttatacgatattaaaatctataatgcgatttcaaccgtgcgaaggaagaaaattggtattattgacaggaacagttactgtgaacggtaactggcagtatgaaaggttaagtaagaatggcaagtatgaaagatgtggcgcagagagccggagtaggagtcggtactgtgtcgagagttatcaatgacagcggatatgtgtctgctgatacacgcaaaaagatagaacgggcaatcgaagaactgggatatacaccaaatgaactggcaagaaatctgtttcgtaatcggacaggaataataggtgttctgattccggatcttgaccacccttttttctccgcgttcgcacgggaaacagagctttcgctttataaactgggatacaaaacaatgatctgtaatacggtcggaagcagtaatcgagagcgtgattatctgaatatgctcgaccgaaatatggtagatgggatcattaccggtgcacatacactccataaaactgaatatgcgaacagaaagcatacgatagttgctctggatcaggatttcggaccggaaattcctataattgggtcagaccatctgtatggaggaaagcttgcagctgagatcatgatcaaaaacggatgtaagcggatcatacaaataacaggtatcgcaccgaacgtagctgccaatgacaggcatacagtatttgaagagtcattgaaagcacatggaatagaagtcttgaatatcgagatggaatggaataaatttgaccatcagtcctactgggacgctgcaaaagaagcaatagaaaaatatccggatgctgatggtgtgtttgcggcagatcagcctgcactgtgttatatgcatcttgcaatacaggcaggaaaaagagtgccggaagatctgaaagtgatcacttacgatggaatggatgtcagcaggctttgctatccggaggtgacagcaatctgtcaaaacgttaaatttttggcagaatcttgtgcgagaaccgtgctggatttgattgatggaaaggaacgcgttccacacagacaggtactatcagtggagttacagcagggtcaaagcacctatccggtggaaattaccggagaaatctaggaattacatataatgaagcagatttttcagaagcagataaaagcataaattgcctttatctgctttttatattatgctgagaatttgttaaaattatgtcgttttagcttgtgcataatatacaaaaacaaatataaaaaattataaaaatgcacggaaatgtgtttttggaaggatttttgtggaatatcggttgacaaatcaggatagaaaggatattataaaaacacgatatggaacggcttccacacaaacaattaaaaagtactaagaacgaaaaaatttttttaaagcacgtggaacgcgttctacaatatttcctttcgcgcggtggaaacagagtttaaaaggaggataattaaaatgaaaaaaaccattagtttagcaatggcagcagcacttgcaatttccggagcagtaacaactgtaccggtattcgcagacgatgtaacaaatatcacaatctggagtcctactgacagagaagcaattgaagcatggtggaaagataagattgcagagtggaataaagatcatccagaaatccaggtaagccgtgaagcaatcgaccgttccgattcttatgcttatgataacaaaattgctacagcagttacctctaatgatcttccggatatcttctatgtagacggacctcaggtttcctactatgcagctaatggcatcacagttccgcttgatgattattttacagatgaggataaagcagatttcgtaaattcttcaatgacgcagaatacatatgatggcaaattatatgctgtaggtgcaacagaatcttctgtagcattctactacaacaaagattacctcaaagaatgtggtgtagatacagacgatcttgactcccgtacacttgaaaacccactgacaacagatgaagttgctgaaatcgctgaaaaatgtacaacagatgattatgtaggaacacacatcatcatggatcacggcgaaggactgccatatgctcttgaaccgctgtatctttccgctggaaaagattatatcagcgaagatggaaaagaagccgatggatatgtgaacagtgaagaagcagtaaacacaacatcatggcttgcagatctgatcgctaaaggatatgcaaacgttgaaccgatcacagacgaattcctcaatggcgcatgtgcaacaatgctcggtggttcatgggaaattgcaacacttgaacagaatgctgactttgactggggtgtaacttactatccggtaaatgctgaaactaaaaaagcagtttctccatgcggtgactggtctgcagcaatctctaaagactgcgagaatgcagatgcagctggtgaattcctggcatggctgatgaacacagacaacgtagcaacatatgcagcagcaattgcaaaacctgcaacacgttcttctgcttatgaaacagaagcaatgactgagtacaaagaaggagcaagagctcttattgtagatcagcttgaaaacacagcagttccgcgtcctagaacaccatcctatgctacattctcatctgcctacgcagaagcaatgacaaacattttctctgatgcagcaagtaatgaagaagtagatacagattatgttcagtccgagcttgatacagcagttgacacatttacagaagactacgaaacatattacgctgaataagaaaattaatgaagacggagccgcatcggcataaaagcggtgcggctctgctttttcttaaaaaggaaaagggggaaaggcaatggcaaaggcagaaaaaaagaagcttaccggccgtaaacgtgatgaaagagtagctgcatatatattcgtagcaccggcagtaattcttctgattgcatttcttgttgtaccaatgatctataccgtatacttttcaggatttaaatatcagatcatgagacctgatgcaatgaaatttatcggttttgaaaactatcagaagcttttcagtgataaaaacttctggcttgcattaaaaaataccgtttattttacagtaattgttgttccttgtcagtgtgcacttgcgctcgctcttgcacttttggtttcaaagaagttccgtggagtggcagtcttccgtaccatgtactttgcaccacagcttacatccatggtagttatctccgtattgtggtcagtactttacaatgcaaatccaaatacaggtctgatcaactcaatccttgtatctcttggaatgagcccgatcaaattcctgagtgatgcaaatacagcgatgaactccatcatctttatgtctgcatggcagggtgccggttatcagatgatgatcttcctggcaggtcttcagggaatcccgagggaccagtacgaagcagcatctgtagatggtgcaaccaagtttaaacagttcctttacatcacgctcccgggactgaagggaactattaaatacgtaattatgatcactatgatccaggcaatgaaactttttacacagccatatatcatgacacagggtggaccgaaaaactccacaaagactcttgtgtattacatttatacacagggcttccagaaaggtaactttggttatgcctgctcgatcgcagctgtattctttgtgatcgttgtatgtatgtctatggcgatgaagaaagtaactgcggcaacagactgagaaaggaggatataaatatgaaaaaatcaatgaggttttctaatgcatttggaaaattcatgttctattttggaaatattatcatcggtatcatctttgtatctcctctgatctggatgatttccgcatcactgaaaccagaagctaagatttttgcaaatatggattcgctgactacttttttaccggttcaggcatccttaaataactatgcagaagtattttcacgactgaatatgcctttggtatttaaaaatacactgctttatattgcactgatccttgttctggatctgcttgtaaactccatgtgcggttatgcattggctaaatttgaattcagaggaaaaggtgcagttctgaatcttgtaattgcactgatggtactgccgatggaagcaatcatgctcccactttacattgaaatgtctcagctcggctgggtaaacacacttgcagcactggttgttccttttgttgcaaaatgcttttctatttatatgttcagacagttcttctgtgacgttccggatgatctgattgaagcggctgcaattgatggctgtagtccgatcagaacatttttccagatcgttatgccaatctccaaaacagtatacgcaactgtatttattcttgattttgtagcacattggaatgattttatgtggccattcctcgttatgacaggagaagataagcgtacgatccagcttgcagttcagtcattttttggaacacagccggtacattacagtgcgatcatggcagcccttgtcgtatctgcaatcccgatgatcattatgtttatcttcatgcagaaatactatgttgaaggcattgcatcatcaggaattaaaggttgatggaaaacagtaataacagggagataaagtattatgagtaaagagaaattaatgagggcaagagaatttgagcaggaacagttaaaaagaatttctccggaagaacgtccctgctatcatgtgacaggtggttccggatggatcaatgatccaaatggattctccttttataaagatgaatatcatctgttttatcagtatcatccgtattctaatgaatgggggccgatgcactggggacatgtgacaagtaaggatcttatcacctgggagagacttccacttgccatggttccggaagaatcctatgataatttcggatgtttctccggaagtggtgttgagcttccggatggccgacatcttctgatgtatacaggtgttggatatgtaagtgatattccaatggccaatggagaacttccaacacaccagacacagtgtctggcagtgggtgatggaacagattacgagaaatatgaaaagaatccggttattaccggagatgatattcccgtaggcggaagcaaagttgatttccgtgatcctaagatctggaaagatgaggatggattttattatgcagttgttgcaaatatgatggacgatggaaacggccggatccttcttttcagaagtacagatgcatttcagtggcagtatgtatgcgtacttgaccacagtgatgaaaaacttggaaaaatgtgggaatgtccggatttctatgaagtagatggaaagcatgtcctggtcgtaagcccgatggcgatgatgccggatggtctgaagttccacgtaggtcacagtgtcatttatctgacaggaacttatgacaaaaagacacatcagtttatcagagaggatgtgcagccgcttgacagtggaattgatttctatgctccgcagagtatgctgacaccggatggccgacgcgtgatgatcgcgtggatgcaggcatggccgaattccaaatttgttccggatggtgtgaaatatttcgggcagatgacagttccgagggaaatcaattaccgtaatggaaaactcattcagcagccggttcgtgagattgaaaattatcgtggagaacatgttcactatgaggatgtggaaatctccgatgaaactgttctgaatggtgtagacggacgtgtgcttgatatgacagtgaagctgaaggtaacagatgagttcaaaaagttcaccattaagcttgctgctgatgaaacctatgattctacgatcacttatgatccggtaagagaagttctctctcttgaccgcagccgcagtggatatatgtatgacatccttcatacaagagatattcaggtaaaaccggcagacggtgaagtgactttgagaatcctcatggacagattcagcgtagagatttttatcaatgacggaagtcagactgcaacaatggtattgtttactcctcagaaagcagataatatcagctttgcagcagatggaaaagctcagataagcgttgaaaaatacacccttaccttttaattaaaatatatgagagaaggcagacgatgcgttatgctcgcctgtcttttttcgtttttgaaagcagtatttttctgttcaggaaagtgaagctgtggtatactaaagtgcagaaaagacagaaacaaatcatttcttaaaacataagaaagaaggatattacagcaatgagtgagacaagaaaattatattatgaagatgtatatacaaaagaatttaccgcaaaagttctggaatgcagagaaggaaaaaaaggttatgagatcattctggaccagacagctttttatccggaaggtggcggacagccatatgatctgggtatactgaatgatgtggaagttctggaagtacatgaaaaagatggagagatcatccattatacaaaagaagcgattgaagcaggcagtgatgttaccggaaagattgactggcacagaagatttgacctgatgcagcagcattccggtgaacatattgtcagcgggcttgtacatgaagcttacggatacgacaatgtcggattccatatgagcagtgatgtgatcacagtagatttaagcggcgtactgagtgaggcacagcttgctgaaattgaggtagagacgaaccgtaagatctgggaaaacagtgaagtagagattacttacccatccagagaagaactggacaaactggattacagaagcaagaaggaactgaccggacaggtgcgcctggtacgttttccgggctccgacctctgtgcatgttgcggaacacatgtgacacatactggtgagattggcgcagtcaagatcctgacagtagaaaacttccatgaggggatccgtctgaccatgatctgtggaaagagagtgatggattatctgaatatggtaaatgatcaaaaccgtcaggtatccatgaaactttctgcaaagattggagagaccgcggcagcagtggcacgtctgcaggatgaaaatttccgtctcaaaggccaggtgaaccacatgtttgatgaactctgtacagtagaggcaaagaactgggaagatgcaggaagcgtgcttcttttccatgagggactggaagctgatcaggtacgcagaatggcagatgcggttatgcagaaatgcagcggatgctgcgccgtattttctgcaaatggagatggaagttacaaatatgcgataggagaacagaatggtgatctgcgtcagtttacaaaagagatgaatgcggcattaaatggacgcggcggtggaaaaccattctttgtacagggatctgtcaaggcatcagaagatgagatccgtcacttcttcaaacagtgatctgaggtaagagaagatgtttggagaatgtcacgcacatgcattgatgaatggtataaactatcgggctgcggtgaatctgcacagagaaggagccaacgaacaagctgtccgggaatgcctgtgcgcatatcaggaatcaggagtttcttttgtgagagatggtggcgatccttatggagtggcaatgctggcatccagacttgccccgaagtatggaattgattaccgtactcctgtttttgctattcacaaaaacgggcattatggctccattgtgggacgtggatttgatgatctgaaagagttccatcagagagttctggaggcaaaagaatcaggtgcagatttcatcaagatcatgacgacaggacttctggattttaagaatcacggcaaagtgacaggagaaccgctggaggccaaagaagtaaaagaaatggtacatattgcccatgaggaaggatttgcggtcatgagtcatacgaatggtgtatatggaacgagggctgcgatcgcagccggcgtggacagcctggaacatggcaattatatggatgaagaaacgctgtccatgcttgctgacagtgatactgtatgggttccgacacttgtaacagtacgaaatctgctcggatgtgggaggtatgatgatgaggtcctcaggccgatcattgtacaggcagagaacctggtacgtcttgcgtttgcaaagaaggtaaaggtagcacccggcagcgatgccggtgcctatatggtgtcacatggtaaaggaatctgccaggaatatgaagctttttgccagatcctgggagatagaccggaagtgcgggagtggctgcaggatggagaatgtgagatccgggaaagattccgtagaaaataatgtaaaaaaggcctgtgagaaatcatctcacaggtcttctatttttaatgcagtatagatattggtctgcctggaatcggccgggttgaaagtgaccttcacggaactgccggtaagaagtccgccagtggattcattagaggcactttctgtattgcaggtgatccgcacgccatcagaagtcagaagggtgatggtgttggcagtggatgcagtaatttctccggaaatagtgaagccggtattgcgttcacttaagttttccgggatatctccggtgataccgaggattgtgagtccatcaagggttgttccattgaagtctccggtataaattacatttacatgtgctccggattcgattccaccactgaaataacagggaattgcagacatgtccagattcaggatgtttgtggtattctctggggatacctgaaggatatttgtctgaatgttctggatcacagcccggagtttgttttccggtttgatctcaactccctcctgaggtgcaggagtaggagtgggtgcaggcacattgagcggatcaatatcagaaacactgtagattttcatctgagaaccatcaagtacatttggatcatcggctgaagctggaccaaaatctcccttatagtgaagataaacccaattgccggctttgatgccgccctgataatattgttctgttcctgtgatcgggaaagtaacggtttttccacctttagatctgatcgtaatggaattggcggtcagattctgaacctgtccacgcgtagttccttcttttacttcggaagtatcatgatagtcgtcaacaactttgagcacgcggacagcgcctgtatccgtactgtcaagctgcccttcgtagattacgctgacagcatcgccacagagcattccgtctgaacattccagagttgcctgggaaatatcaaagacatagttatccgatccgctgagaagagtaagctgattaccggtaaaatactgaagagtaccccggatctcatccatatatacacgggtgcttccaggattgatgtcctgaatctgtgtatcttctgaatctgagaaacgatcaacaatatctcccagactgcagccggataaagtgatcagaaaaagtgatccgatacagaccaccagtatttttttcatgaaactcctttctgtgttacagctttaggctgcacacggaaccaatacgtataaaaatcagtaaagccaagagatgcatacagtcgtttggcagcggtatttccctgaacgacctgaagataggcattttcagcaccttttttcatgccctccgtgagaagtgcagtacagatctggcgtgcaaatccctgtctgcgatagttttcctttacatggatcgcgtagattccgatgtagtcacggtcaaggataccaagtcctgtagcgatgatcttcccctctttccagatggaagcacagatcgtttctttgggaatggcacgatacatagaaggaacaacggcccggtggatcgggtttgtcattcctttcagatcaaaaagacttgtgatccagatatccggaatctcatccgtgatcgttacggcagaatatggcgtatccagacgtgcatcactcagatgaagcgtcatgacttcagttacatgctggatctcataaccacggttttcgagagtataatcaaaatccggagataccagcggactgatcttaaagatagcaggagatcccagacgtttgtaaacatcttcgcagtaggcaaccttttcacgccatggaagcgtagagtttccaaattgttccacactgttggtacggtgcgtatagaaataagaaaatcgcaggatccagccatcgtaaagttccattttgtgagatggccaggcattcagcgacatatcttcgatttttttgatgtttttttccatgatgaagataaagccccccttttgctgttgctttttattatacccaacagaagcggattgtgcaaccgcaagtccggtgcataaatgtcagaaatacagagaatttggcgaacgaatcttctttacaaaacggcacggtccgttctataataaaactcaccagagatcttctggtattcataaccgtcggttcagacggaaatcccttttttatgattgagataattgtatacagaaaggagtgtgattggtgttattggtggcaggatactgcttctgacgatcaccggagttgctgttttaatggatctgtatcagatgaaaataaaaaacagctggatccttttttcgatgctgatcgggttcggatatgatctgtggcgtggaggatggaatggaacggcattttttatttcaggtacaggaattccactggtggttctcggatggctgttttatttccgaatgcttggttcgggagatatcaaacttttttgtgtactgggaggaattatgggaccagtacatattctgtggtgtatctggtatgcatttctgacaggagggctgctttcactggccattctgatcttgtgcggcggtttcagccagcgaatccaatatttggtcaaatatatgaaaatgtatatccggacaggcgaacggaaagcttattaccgaaatgggactgcgtgggaaaatattcatttcacggttcctgtctttatgagtgtgatgctgtatgcaggaggtatgtattgaaaaaacaaatttttgcagtctgtgatctggaggcagagtatgcctgcaactttatggactatctgaatcagaagaaaaatatcccttttgaaatccaggcttttaccagtgtggaaagtctggtggcgtatgtgaagaagaaccccgtagagttgctgttgatttcttcggaggcaatgtgccgggaagtaggagaactggatattggtaagatcgtgatcctgacagagggaagtaagccaaaggaactggagaagtatactggtgtgtacaaatatcaggcatcatcagatgtagtacgcgaagtgatggcctgttatggtgcggagaaggcaattcttccggcgcagctgccagtattaaagaagacgacggagatactgggagtatattcgccgctgggaggctgccttcagacttgctttgcactgacactggcgcagatattgggcagagaaaaaagtgtcctttatctgaatctggaagagtatgccgggtttgaagaactgatgcagaaaaaatttttacatacactcagtgatcttctgtattttgtaaaacagggaagtacagggattacagttaagatgaatggaatggcagagagtatgggaaacgtggattttattccacctgtgcagtcaccggaggatatcagaggaacttcctggcaggattgggaacatcttttgcaggagatcattctccacagttcttatgagatgattgtacttgatataggaaacgggatcgaggaggtttttcagatgctggacatgtgtactacggtttatactccgataaaaacagacaaaatgtcacggagtaaactggcacagtttgaagaacttctgagtgtgcgggattatccgcagattttgagccgtatggtaaaactgaatctgccgtatggacaggaagtcctggcagagccgtttcgcgcagagcagctggtctggggaacgcttggcgattttgtcagagaactgctcggaaaggatgaggtatgagcagagaaacttttcagtcactgagaatgcttctgatggaaaaactggatcttgcaagagaactgacagatgaagagatcctggaagaaattgatacactgattctggagaggatgcgggattcctgcctttctctgaaggaaaaagtacagctccgtcaggaattgtttcattctgtaagaaaactggatgtgctgcaggaactgatcgaggacgaaacggtgacagagatcatggtaaatggtccggatgcaatatttgtggaacgggccggaaagctttcccgttgggaaaagacctttacttccggagaaaagctggaagatgtgatccagcagatcgtcggaaaatgcaaccgggtggtcaacgaatcaatgcctattgtggatgcccgtctggagaacggagccagagtgaatgcggtggtccgcccggttgcattgaatggtccgatactgacgatccgccgttttccggatacaccgatcaccatggaaaaactgatcgcgcttggaagtctgcctgcggaatgtgcggaatttctgaaaacactggtcagggcaagatattccatggtcattggcggaggaacaggaagtggaaaaacaacgtttcttggagcactgtccaattttatacccagtgacgagagactaatcactattgaagacaatgcagaactgaagattcagggtattgagaatctggtacgtctggaggcaaagatggcaaatacagaaggtgcaacatcagttacgatacgtgatctgatcaagaccgctcttcgtatgcgaccggaccgtattgttgtgggtgaagtccgcggaggcgaggcggtagatatgctacaggcactgaataccggtcatgaaggcagtttgagtacggcacatgccaattcggccgaggatatgctctctcgtctggaaacaatgactttgatgggagtagatcttccgctggaagcgattcgacgtcagattgcctcaggagtggatatactgatccatctgggaagaatgcgggataaaagccggaaagtactggagataacagaaatctgtggattcgaagatcatgaaataaaaacccggacattatatcagtggcaggagggaaaagggctggtgcagattgcgtcccttctgaaccgggaaaaactgatacgggcaggggtgactatatgaaacagaattatgcggaatatcatttttcaaaaacagagattctgaaatatctgatacagagcattctgctctgtggagcaatggattatctgttttatcaaaactggtggctgatgctgctgacagttcctgttactgtcctgtttatgagactgaaaaagaaaggattgatcagagaacgaaaaaggaaactgaattatcagttcaaggatgcgctgaatgcattaagcgtagctgtacaggctggttactctgtcgaaaatgcagtggcagcatgttccagggacctggagagactgtatccgaaagagacagatatcgtgaaggagtttcattacatagaaacacagctcagagtcagtgttccggttgaggaacttttactgagccttggagacaggagtggtattgaagatgtggaaaattttgctgcagtattttacaccgccaagagaaccggtggagatatgaatcggatcatacagacttctgcgcggatgcttggagacaagatcgatgtccgtaaagaaattgagacaacgctggcggcaaagaaagcagaacagatgatcatgagtctgatgccggccggaatcattctctacctgaaactgacctctccgggattcttaagcgtactgtatgggaatctttttggaatgtgtgcgatgacactttgtctggggatttatgtgttatcttactggcttgggcgcagaattgttgatattgaagtgtaggagaaagcagtatgtgggtacattttattatttttatgacagcgtttggcactgtgctagtctggaaagcagggtggctcaggctggatggtattgctgataaagaaagcctccgtctgtttctgatcgttgccgtctgtggaaatctggcaggaatggcgatgacactgacaaatggagacagtgaaatttatcagaaaggccacagaatcgagaagagtgaggatggggcttatacggaggaactgcaggtttccgtaggtgatgggaagccggagaaagttgctgttcagattccggaaaaagagacagaagaaacggaagcggaaaatgcacaagtgaagcagtcaccggaagaaatgagacagaaagagctgaaagaagtgattgaacagtataacagggaaaaacaggatccggattattattatctgccggattcctgggatggccagacacttaagtggcagaaacccggggagagtactggaacacttctggcagcactggccctgtttgcggcagtcgtgctgatgttaaaaaaagcgagagaacagcaggaagagatggcaaaacgggcagaacagcttctgatggattatccgtcgctgatcatgaagtttacacttctgatccaggcaggtatgacggttcgcagagcatttcagaagatcagttcagattatctgagaaattgtccgaaagaaggacgatatgcatatgaagccgtgacgacgacctgccatgaaatggacagtggtgtggcagaactggaagcttaccgaaggtttggagagcggtgtggacagatgaaatataaaacattttctacgatcctgattcagaatctccagaaaggcggacacaggatggcagatcttctggaaaaagaagctctggaagcatgggatgaaagaaaaagaaaggcaagggtaatgggggaaacagcagcaacaaagttgcttgttccaatgatcatgatgcttgcggtggtgatggcgatcatcatgatacctgcatttttgtcgttctatggatgattgtataaaaaacgaggaggtaaaacaatgcgggattatctgcaaacagcaaaagaatttgtatacgaagaagatgcagtaggggttgtggagattattctgatcctggtggtgttgatcagccttgtcattatttttaaagagcagctgacaaatctggtacaggcaatcttaagtaaaatcacaaaacagagtaattcgatttgatgaagaaaggagagagccgatggagaaaaagggcagtattactgtttttctggcgctgatcttaagtctcctgctatcactggttgcaacgagcattcaatctgtgcaggcagcggcagcgagaacacagattctgaacagtatggatattggactttattctttgtttggacaatatgatcgttttcttctgaaaaattatgatctgttttttctggatggaacacagggaggaacagatctgaatctggcagcagtttatgataactttgagtcttatatgaaaccgatactgaaacagaacagtcagaagctgaaactcaggcagggtggtttcagtggatatcgtctggcaacagatgaagatggcgaagtcttttaccagcaggcagttacttatatgaaagatacgcttggaagtcagggagtacagacacttgtgaagcgatataagaaaaaagagcagaaagtgaagcaggcagagaaagatggaaaacaggcggaagcagggaatacactggaaaattatgattccgaaatgaattctgcggcacagaagagccaggaagccaaagaggcttcaaagaaggaagaatccggagattttggtgatggcacttcgggagagagtttttcagatggagaggtaaaaccgcaggtggtaaatccagttccggtgattcagaggattcggcgtatgggacttctggatctggtcgttccagcatcaaaaggaatttctgatcagaaaatctcacatggagatctgttatcaggaagaacacttcaacagggaatggcgatgccgcagaaaacgggaaaagataattccggatcagcaaaagtactgtttcagcagtatctgatggagcatctgggaaactatatttctccttctgaagcagggctgcattatcagctggaatatcttctggcgggaaagaaaagtgatcaggaaaatctaaaagtcgtggcaaagcgtcttctgctgatcagagagggaattaatgcatcctgtcttatggcggatgccggaaaaagggcccagattcaggcacttgccctggcaattgcatcgggatttctgataccgcctgcagcagtggcgattgaggcggcactgattttgtgctggtcctttgcagaaagtattctggatcttcgggagctgtttcatggaggcagagtaccattgactaagacggcagcaacctggcagctttctctggaaaacctgccgaatctccttgagggactggacagccagagaagggatgcgaaaggtggaatgtcctatgaagattatctgcaggtgctgcttttgtcaaaatcaaaagcagtcaagctgacaagaggtatggacatgatcgaagcggaaatccgcagtacaaaaggaaaggaaggtttccggctggactgctgcatagaagcggctgaaatatctgtggatgtagaggcaaaccgaaagcagactttttcggtgacaaggcagtacagttatatttaaaaactggatttaaatgaatttaaggaaatacgggcggcgacgagccgccccacggaaaagaggtgcagaaagatgctttttcagaaggaaaaagattatgggaatactatcacaaagataggtagaaagaaaaacaaaaaaaacgagactgcaaaaaagaaaagaaaaataaaaaaagaaaggaaatgctctcttaaaaacagaatcctggcttcctcgatggtcagaagaatctcaaatttatttttaaacacatcttctgaaaaagtatctttctgtgccttgaacaaaaaggcgagtctggcgttggaaacagcacttgtgcttcctatgtttttgctaggaatggtgacgatgatctcttttatggatatttaccggattcagacagaacatctgcaggcattatgtgaaaagacaaaagaagccggaatgtatgcatatgtgttggatggaaaggggccggaagaaattacattgccggatgtctatgcatatactccaatcggagcacttgttcctttgccgaaggtatggatgcataacacagtaaaagtccatgcatggacaggagctgatgagacagcgttttccggagagaccagagaaccggaagaaatggtgtatgtgacagaaacgggaacggtataccataagaaggcaggatgtcgttatctgaaggtatccattaatcagatttcgggttcatctctgacgcatgcccgtaatgacagcggacagaagtacagtccctgtgaaagctgcagtcgaaatcagaaaccatccggggtggtgtatgttacatcttcgggaaatcgatatcacaatcttgctacatgcagtggcttgaaaagaactgtaaaactggtaaaagaatcacagcttggaggaatgcatgcctgcagcagctgtggataagaggcagaggattatgcagatcagagaagtaatgaccgtgttgttcctggcagttatgggctggaaagactggaagaaaaaagaaatttcactgttgctgacaggtacgtatggaatcattggtcttgcctttagcatttatgcagaaagaccactggaagactggctgctgccatttggtgtgagcctgatgatactggcggtaagtgttctgaccggtggagagattggaatgggcgatggctggatttttctggcactaggaacaatgctgcatacagaaatgtatgtaagaatggcatgtatcggaatgttgatcgcagcggtgtatgcgggagtccttctggttatatacaaaaaaggacgcaagacagaaattccactggtgcctttcttactgtttggatatctgggaggattattgctatgaaagtcagaaaaggaagttttacaatagaggcagcctgcgtgatgtcgcttgtgctgataacggtaatgggagttttatatctttccttctttgtacataatcgttcctggctgacggctgcagcgtacgaggcggcactggcgggaagtatagaaggtgtacaaaaaaccggacagatatatgaagccgcttctgcaaaagcacaggaacttggaaatgtgggattctttggcgcagagaatctgtcttaccaggtcagcgatggaaaaacagtaaaagtctcctatcaggcagatacaatcgctggatttggaggttttcgctgggtactgcggacggagggcagttcaaagatcattcgtccggcgcagtggatccgcaaagtaaaagcagcatctgaaatcgtgaaggatacagaataataagagtacaggatcatataggagagtgtaaaatatgtttgcagaatataaaagagatgtaagtcataattatctgatcctccatggggatgaaacaatcaataccacttcttatcaggtacggatcctgacaggaaatacaatgtcttctatattaaaatgccgcatgcagggactggatggaacatggctcttttattatgatatcacttcaaagcagtcgctggcatctttttacgaacagcgtaaactgcagggagaagatctggaaatgattttgaaaggatttctccatgtaatagaagaaatggcagagtttcttctgaatacggaacaactggtactttgcccggaatatatttttctggatgtggagaaaaaagaggtttcgttctgctgtctgccggattatcaccatccggtgcaggaacagtttcgggaactgaccgaatatttgttgcccaaacttgaccatgaggatccgacagctgtaaatcttggatatggaatttaccgaaaagccatggagccagggatgcagctggaaaatattaaggaattgctttatcgatctgagaacagtaaagagaaaattgcagagagcgatacaaaaatcagagataaggaagagtacgtggaagaaatggaggagccaccgcaattttttcaggaggaaaaaaaggagaaaaaggacaggaagtggcagcctgcagccgggtgtgcagtgggggttctgttcctgctgggaattctcattttccgctatctgggatattttccggaaattccaatagaaactgtattgggggcggcaatactcctgatgggagttggagcaggatggacctggatggaagaaaaaaagaagaaaaaacaggaacagtctgcagaatggagaaacaaagtacagcgggaacttgccggaatgaatatagaaaaacatgaaacagagagaaacaatacagagagaaaagaaataaaagatatagagcaaaagagtgaaaaacaaaaccgtacagaacaaaattcatgggaatgtgagaaaactggtgaggatacagcagaacaggaaacatatggtgaaacggtagttctttcggcaggacagctgtcaggtacagccagcctggtaagtcgggaacccggagaacttccgacggtttatctggaacgggaactgaccgtgatcggaaaactggaacaggcttcggatgtagtgatctcgcttccgacagtcagccgggtgcatgcaagaatacgcaaaacaggtgagaactattatctggcagatctgaattccaggaatggaacttctgttaatggcagaatgcttggggcagaggaagaatattttctgcaggatgaggatcaggtggattttgctcaggcaagatatgtatttctgaggggatagataacttctgaaaagaaaatcaccggacatgagggttcgaaggcagtatttcggacagcacaggtgaagtgttgccttgccacagggaacggcatctgctaaaatagacgaacaacagcagaatacatatgtattctctgaatacaaaaacagaggagagtaacctgtggaagaattacgcaaagagccggtgactgccggactgatcttgttgaatattctagtatttctgatcgtggaatttacaggaagctcccagaataccatgcatatgctggattgtggagctgcctttacaccaatgatcattcagggtggagaatattacagactgttcacctgtatgtttctgcattttggaattgaacatcttctgaataacatgctggttttatttgtacttggaagcagactggaacaggcaattggaaaaataaaatttctgttgatctatctgatcggtggagtacttggaaatgtgatttctttacttatcgaattacgtacgcaggattttgctgtatcagcaggagcatccggagcggtgtttgcagttatgggagccatgatctatattgtcattcgcaataaaggatggctgggtgatctgtccatgagacagattctggtcatggcagctttttctctgtattttggttttgcaagtacgggagtggataacacagcccatgtaggcgggatggtgtccgggttctttcttgcagtgattttttatcatcctggaagaaaaatataaaaggaagtaccttctttcggagtgctttctacacatagtgtaccctggtgggcttcaatgatctgccgggtgacagcaagcccgaggccagtgcccccgggcttgtatgttacgaagggacgaaaggcgttttcaatctggtcttctgtcatgccacatccgttatccgagatggtgatctggacaccgtccggaacgacagaagcggaaaaaagaattctgccatgagtatgctggatagattcctgcgcattacggagaaggttaaaaagagcctgacggattttggtctgatccagactgatctggggaagatcacgggggatgtcagtctcaaaggagattccaaggtagtccagtgccggtcgaaaggaactggtaattcgatccaggcagatacttaaatttgtctgtacaagggtaatgtgaccggcattttgatatctggaaagttcatccagcagctcacggatatagttcaggttttccataatgttatcccagtgttcgttgaaacagagctgtggctgtgaatccgacaacatctgcatttcgctggtgatcaatgccagcggatttcttatttcatgcgaaaatgtggacaacatcgactgaaactctttttttgtttgtgtgataatgtttttttcctgcataatctgtcacctcaatctgagtatattatgcaaaaatatcggaatcaacaaatttcgtattgaaaaaatcgcgaaaatacgagacaatagaaaaagaaaacagtttatttgtaaggaggactacatcatggaaaactgtattttttgtaaaattgcaaacggagaaattccatccgctactttatatgaagacgaagattttcgcgtaattctggatctcggtccggcgtcaaagggacatgcactgatcctgccaaaagctcatgcagccaatatttatgaacttccggatgagactgccggaaaagcaatgatccttgccaaacatatggcaaccaagctcagagacggactgcactgtgacgggtttaacattgtgcagaacaatggagaaattgcaggtcagaccgtatttcatttccatatgcatctgattccacgttatgaaggtgatcaggtcggacttacatggaaaccgggagaactgacagatgaaatgaaggaagagatcctggcaaaagtcaaagcataaagaaaagagcacagatacagatgataattgagaattttgatgatttttacgatcactaccaaggattctcagcatatgtcgctttttgcatcacagaagattacgagctttcaaaagatatcagtcaggaagtttttctggcattatttaaagtgaaagaaaaactggattattccagacctgacaaattgaaagcactggtgatgaaagcgacatccaacaaatgtatggactattatagaaaagcctcatccagacaggaaagttatacgattgatgatgaggaaaatgcgtatgagccggtggatgaaaagagtaatccagaggcaagaatacttcgtatggaagaagagaaatatcagaaacttgtactgaacagacttcggaagaggaatccgatgaattacgatattctggtcaaaacaaaattccaggaactttcagcagcagaagtggcaagtgagtatgggattacaccgaataatgtaaacaacaggaatctgcggtcgaaagcctggataattgaagaaatggaaaagatatgcaggcagtcacatcgataactgcctgcatcctgctatttgtttatttttttgataaaacacattcttcgatcagagaaacgatatgatggatggaatccatctgtttgcctgcagacattgcttcttcgaaagaatgacggttgtcatacagctgatggatcgtatccagaagtttctcatcagtgatttcttcttcctcaagtaccatgctgaatccctgtttttcgaaagaacgggcattcaggatctggtcaccacggctggcattagcagacagcggaattagaagatttggtttgtgaagagcactgatctcacagatggcgtttgcacctgcgcgggagattaccacgtcagacagggcaaaaagatccggaagttcttctttgatatattcatactgaacgtagccttcggtacccttgagggtctcatccattttgcccttgccgcagagatggatcacctggaaagctttcagaagttccgggagaatcttgcggatatggtcatttacagaggctgcgccaaggcttccaccgatcaccatcagtaccggtttgtcagaagtaaatccacagaactgacggccggcttccttatcacctttcatcagctcctgacggatcggcgtgccggtcagtacggctttatctgccggaagactgctgacagtctcaggaaagttacagcatactttaacggctgatggaatacacagtttgttggcaagtcccggagtcatatctgattcgtggatgattgctggaatcttgcagcgtttggctgcaattacaacagggacggtaacgaaaccacccttggaaaagactacatcgggtttcagttttttgagaagcttctttgcttcatggaacccttttaatacccggaaaggatcggagaagttcttgggatcgaaataacgtctcagctttccagatgagatcccataatatggaatacccatttcttcaatgagtttacgttcgataccttcgtaagatccgatataggaaatctgatatccggcagctttgagtgtcgggatcagagcaatatttggtgtgacatgtccggcagtaccgccgccggtaagtacaatatgtttcatagggaaaacctcctgaaaatcattttattaccaataactatgaaccaccggggaagaattgtcaagaaagagataatatcatgaaaaaagagtttgagaaagaacagaacgacaatcagatagatgatgcattcctggatatgccggatatggaggatgacgagaaattccgtcagtggctggaagaggaatatctgaaggaagcagatgccatcgaggaagctctttttgatggcagaaaatttgaggacaatcaggatatcgtagagaaactgagcgtttccagagaaagtttctatcagcgtgccagagaagaaggtctgctggaggatacagcagatgaaaaggcagaagatgagaagaatacagaagaagcagtgcctgaatctacggaaaagaaaattctggaattcagaaaaaacgcaggtgtatcaaaggatgctgcacgtgatgcgaacagaaactccagcaaaaggaaacacagttatgtgcgctttgacagaatcgccggaatcgcgggcctgtgtctgatctgcgtgttcgctgcaagtatgagcagcgaggcgaaccggaagtatctggtgaacagtgtgcggatattgagtgggaatgacagccagtttataacagataattcttctgataatgagcatgcaactacagaagaaagcgatgcgattgcagacatagaagagaaactggatgtaaagatgccggagttttattatcggccgtatgggatggagttttatgcgtacgaggttaatagtgacaatttttatgcgaaaatagagtatgagtatgaaaataatattttatttttttatattgataaacaggatataagtgcagaaagtaatatcagtagtttaaaaggagaaaatagggtaatagaaaaaatagacagagacgatttaaatatcataataaaaaaagtagaagatggaacggagaaattacctacatatattgctagttgggaatacgaaaatactgtatattatctggtaggaaaaattgaaatagatgaattgaaaaaaattgtgaaagaaatgaaattttagagtgatattttcggatttcatacgtatatagttatgtaaaggttgtttacatggcgaaaggaagtgagaagtgaatatctggaaaaagattctgggaatcagtatggcggttggcttatcggttggaatgagtattgcaccggtctatgcagcagatacgattagtattctcgatgagattacagatgaagagacaacagaagattatgcagaagatacttcaacgattttggctagaagcagttatttgaatctgggaaacgtaaaaattcgaaaagtttctagcaatgaagtaatgataactggtataactcagtgtcacaaaaaatgtagtaaagtgtatttgtcactttatctggaacggaaggtcaatggaagctacggcacgtataaatactggaattttacagcaaacaatgcaacaagtttgagtaaaacaatcgacgtagcagttccatcaggtacatattaccgtgtgcgtggataccatgcagccagccagtcgggtacaaaagaatctacctctacgctgacaagtggtatcatggtcaaataatgaccattggaaaaggaaaaaggaagaaaagaagaaaaatattattcagtaatccgtgaagtgcgaagaaggtcgcaggatgcaaaataaatttatgtaaacaccgttaccgtccggggacatcaacgtactcacaaatcatgtcggactcgtcagagttcacattattcatgatcttatgcgcaaaggaataacataatcatacgcaaaaaaaggatcatttaaccatatctacaaaatcatatgaaccatacaaaacaaggcgggacttcatacaccccgccttattttacataaaaagaaatataaataatatttgaatagtatatgtttttgcatggtatattgcaaattaaaagaacatatgctataatgccagtaggcaaaacgataagatgtgttcacagtagcacagcaaaaactccccagagttcgcacctctggggagtttttattccattttggcgaggcggcttagacctcaggctggctactagctgctattttccatccagccatttgcaaatgtagtaggcgattacacttgccagaatggaaagcataaacgataaaattgaattcacaatagcataccccctttctgtacctgtctaggggcagtagcaaaagcattataacatgaagccctggtcgaaaaaacgcaatttttgttaagatatattgtcttttttgcacaaaaagactgttaaaaatcaatcaaatcgtgtataatggttacaacaaaacatacttggatgatttttcagacaaagggggttcgcacatgaagattacctttattggggcgacacatgaagtaaccggaagctgttattatctggaagcagcaggaaagaaattcctggtagactgcggtatggaacagggtccggattactacgagaatcaggatattcctgtaaatggaagtgacctggattttgttcttctgacccatgcacatatggatcactccggaaatcttccagctatctacgcaaaaggatttcagggaccgatttatgcaacacaggctacctgccacctttgtgacattatgcttcgagacagtgcccacattcagatgttcgaggcagaatggcgaaaccgtaaaggacgtcgtcagggaaaaccggaatttgttcctgcatacaccatggaagatgccatgggtgtcattcagaacttcgttccgtgtccgtacgaaaaaaccattaaaccggccgagggaatcagcgtacgtttcgtagatgccggacatctccttggatctgcgagcattgagatcatcattcaggaagatgacaaagaaaagaaaatagtcttctccggcgatatcggtaatctgaatcagccactgatcaaggatccggtttatctccatgatgcagattatgtaatcatggaatctacttacggtgacagaagccacggtgaacgcccggattatgtagcaatgcttaccgaagtgatccagcatacttttgaccgtggtggaagcgttgtcattccttcttttgcagtcggacgtacgcaggagatgctgtattttatccgacagattaaagaagaaggacgtgtacacggacacgataactttaaggtctatgtcgacagcccgctggcaaatgaagcgacaacgatctttaatgaacatatttatgactgctttgatgaagaagcgatggcactggtcaaaaagggaatcaacccgttgatgttcccgggattaaagacctcgattaccagtgacgattcaaaagcaatcaactttgacgaagactgcaaggttatcatttccgcgagcggtatgtgcgatgccggccgaatcaaacatcatctgaaacataatctgtggaatccgaacaatacgattctgtttgttgggtatcaggcaatcggaacgcttggccgtgccctgatcgaaggtgcgaccgaagttaaactgtttggtgagacggttgctgtaggcgcggagatccgtcagatgccgggtatcagcggtcatgcggatgtgaatggcctgatgacctggatcaagtcattcaaagaaaaaccggaaaaagtatttgtcacccacggcgatgatgaagtgaccgagatctttgcaagaagactgcaggaggaactgggactggattctatggcaccgttcagcggaaccgtctatgatctggcgaacaatacctgtatctatgaggcacagggaatcaaaatcacgaaagcttctgtttctccgaaagcaagcagagccgcacgtgcattccagaagctggttgccatgggacagcgccttatgtctgttatccgaaagaacgaaggcatgccgaacaaagacctggagcgtttcagcagagatatacagtcgctgtgtgacaagtgggacagagatgatctctcctgatgtttaaatccggctgttataacagaaattatagataaataatataaaaagactgccgtttctttgattggaaataaaaaatcttccagtcagaggagcgacagtcttttgcattgggtttcgacccgaaattttaagatcagttcagagcttctttcagagcttttgcaagctgatccgggcaggatgttggtttgaagccacaacgaatcccttccattctgctgatagcttctttggcatccatgccttctaccagtctggcaacgccctgtgtattaccggagcagccgccctggaattttacatcatgaacttttcctgcatcgtcgatctcaaatgaaatggcgcttgaacagacaccagatgttttatataccataatcttaacctcctgagttcagttattgtaaataataacaatatatttttccaataagtataccagaaaaggacaaagcggacaagtctgccgcagattttccagaggaattccccgtgaagcaaaaaaagtttccatataaacgcaacatttgctataatagactatgctattcacaatcagggatgataacagattacagtgcccggcttttcagaaaaagggcacgatgataaaggagattacaatattatgagatgtattggtattataggagcaatggaagttgaagtagcaagtctcaaagaacagatgaaagatattcaggtgacacgtaaggcttccatggaattttattcaggtattatcgaaggaaaaaacgtagttgttgtccgttctggaattggtaaggtcaatgcagcagtctgcacacagattctgatcgatgatttcaaagcagaagtagtgatcaacaccggtatcgcaggaagtctgaatgcagacatcaacattggagatatcgttgtttccacagatctgatccatcatgatatgaatgccgttgcatttggttatccggttggacagattccgcagatggaagctttttctttccacagtgatgatgcacttcgcgcacttgcagtaaaagcatgcaaagaagcaaatcctgatatcgaagtattcgagggacgcattgcatccggtgaccagtttgtggcagaccagggtgtcaaagattttattacaaaagaatttggagcatacgctgttgaaatggaaggcgcggcaatcgcacaggcagcatatctgaacaatgtacctttccttgtgatccgtgcaatttctgacaaagcagatggaagtgcagagatggattatccgacattcgaagcgcaggcagcagagcacagtttcaaactgacactccgcattctgaaagacattcagggctgaagcgcacacttgaaaagattctgcatagaatgttatagatgatgacgaaacaggagcctgtccatgtattatgacaagtttcttccattttatatgacgtatgcagattcttctctttacagcagagagagaatacaggagcaggaatttgctctgatgaaatcttattatccggaaactgcccgcaaaattcaggaaaaagttgaagaagaatgtcagcttatggattatgagggaagcagactttatgatgagcatccggacaaatttatgatgcatcggctctacaggcagatacgttctcaggtagacggagaaatggcagcgcaggagattcctgatgaatttctggatgaactgatccaggtgcttttgtatcaggagatttccaggcgccggtgcagacgacgcagataccgtggattctgacagttgagcgaataagaacactgcagttcgtaatgccggaatccgatggtgtacacaggggcattacagagggattatgaaagattaaatatgatgacattacaggaatttttggaaaaacaatttgatgaaaacctgatgcttgcagtcttaagcggccagcggagcaaggaaaaagaggctccttccaaggtgcggatccgccagatagaactgaaaggcagcgtctgttatcaggcatcctccacggtgggaaccaaggtccttcactccaattacagcagagaagaagtgatcgcatatgtggaacagagtcttcaggagggtggattttcccagctgcaggtgcagggaagatgcaaagatggcagtgttcttgtcagcaaaaagggtaaagtaactgtcaaagtgaaagagcatcaggcgaaagagcctgttcagattctggcacacaatcgtgtaaaacagtatatattgaaggaaggaactccggttccattcctggtggatctgggagttatgaataaagaaggaaagatccatcgtccggcttatgacaagttcaaacagatcaaccgtttcctggagtttattgaggatattcttccggcattgtccagggagcgggaggtcacgatcctggattttggatgtggcaaatcatatctgacatttgccatgtattattatctgaaggaactcaaaaaatatgacgttcatatcattgggttggacctgaaggaagatgtgatccggaaatgcaatggactggcagaaaaatacggatatgagaaactgcattttctgtgtggtgatattgcggaatatgaaggtgtgcagaaagtagatatggtggtaacgttccatgcatgtgacaaagcaaccgattatgcacttgccaaagcggttgagtgggatgcgcaggtgatactgtctgttccatgctgtcagcatgaactgaatgaccagattcagaataaactgctttctccggtgctgaaatatggacttctgaaagaaagaatgtctgcacttcttacagacggaatccgtgcagaacttctggaatcgaagggatacagtacgcagattctggaatttattgatatggaacatacaccgaagaatctcctgatccgggcagtaaagacaggcagatcccgttcgggtgaagctttgaaagagatgacggatgccattcatggccatctgactctggaaaaacttctctatccggatggatttgatgcgaaggagggagtatgagaaccataacaagatttttgagaaggtttttaatacttctgatcgtgtttgtaatgggagtagcgggaactgcttttctcatgaataatgagacgacggatgatcgttccgatatgaataatccgacgttgccagaagtaatggtggattttaacggtacgctggcaaacagaatgtatggatatcgccagccgatggaagcagattttgtccgcgacagtgtaacaccgctggatacaacgaagaaacttacgatcgccgttaatccttatgaggaaaaaatcaaaagtctgtcctatgaagtgcgtacttcggatggaaccaagatcgttgagaatcgtaaggtcaagagtcttgacagctcaggatctgacggatatctgcgtgcacagatcgagatcagttccggtcttttgatgaatcaggagtattcccttcagatctcactggataccagtgacggagaagcgtattattacacaagagtagtttccaggtcttcgacgaatacggaggattatgtgaagtttgcttccagttttgcacagatgtgcatggataaaaactctgcagacggactcgcggcctatttggaatctacagaatcttcttcaacaaattttacggctgtgacgatacagtcaccactttctacgatcagctggggaaatttaagtccgcagatatccaagaaaggcatcccggtcattaaagagatcaatgagacgacggcgagtatttcactgaaatatgagataaaggcagccaacgaaaatggtggtgcagagtattacaatgtgacggatttttaccggcttcgctatacggataccagaattatgctgttggattttcagcgaagcgcagatcaggtatttgatcctcagcagacagtgatcacagatgatgggctgcttcttggagtccgggacaaaaatgtcacgatgctttccaatgaagatggcagtgtgactgcttttacgcaggaaggtgccttgtggacttatgcaccggataccggcaaatttgtagatatctttgatttccgcagaaaatcaaatggagattttcgtgactccagaatagaacatgatatcaagctgctgggcattaatgacagtggggatctggatttcatggtttatggttatatgaaccgcggaacatatgaaggatattgtggtgttggaatctatcattatgaccatgatcagaatgttgtagaggaacgtgtgtttattccaacgtcagaatcatttgaattcctgaaatcagaccttggaacgctgagctatgtgaataaagataatcagctgtttcttttgcttgcaggcaagctttatcagatcaatattgatgaaagcagttatgatgtgcttgcagataatattgatggaaatcagtttgcggtttcggctaccaatgcacatgcagcatggcggatcagcgacggggatcaggctggtcaggtaaaattcatcgattttgacacactggaaacaagaaacgatacaccggatgcaggacagagccttcgtgtgctgggatttatgaatgaagaggtggtctatggtatcgttttggatggtgacagtcttacagatgaaaacggacatactacagatggaattacttcaatcagaattgaaggttttgacggaactgtcaaaaaggagtatcatcaggatggatattatattacagatgtgacggtcggaagtacccttatgcagtttaatctttctgaaaaaactggaagctcttatactgtgaaaaataaggacaacatcatgaataatcaggcagcggcagcaaaggttgtttctgctgaacagagcagtacaacccgtcagggcgtgatcgtcaagctggcatttgacaacaaaccggaaacagacgaaccgttgattcttactgcaaagatgaaaaatacaggggaaaaaacagttcaactggatgttgacaagagtcagatcagtaatatttattatgtatatgcaaagggcggactggatagtacgtggacagatccggcacaggcaattctccatgcagacagtctgacaggtgtggttctgaaccgggcacagcaatatgtatgggaacgtggaaatatgaaaacacagctgacgctgaatacagaggatgttccggagatcattcgaagtggttcctgggacaaagacgttctgcagcagggactgggagattcaggaacggtgatcgaccttaccggatgcagtttggaaaatgtactctatgaaatcagtgcacagcgtgcggttatagccaagaccggtgcagattccagtgtagtgatcgttggatacgatcagtacaatacctggcttcttgatccggcaacaggcgaagtaagtccttacggaatgaacgacagtacagcgttattccaggcagcaggaaatgtctttatttcctatcttgataaccaaaaataaatttaacagggggacaggcttatgttaagcaaaagcatcacgaaacttgtacagtatggaatggaaacagggctggtaccggagtgtgaaaaaaattacaccatcaatcttcttctggatgtatttcatgaagacgaatatgtagaaccggaagagagcttttctgatgtagatctggaagaaactttaaatgaacttctggatgaagctgtaaagagaggtctgatcgaagatagtgttgtgtatcgtgatctttttgatacaagactgatgaactgtctgatgccgcgtccggcgcaggttcagaaagaattctgggataagtatcagaacagtccgcaggaagctaccgattacttctataaattaagccaggacagcaactatattcgccgctatcgtgtaaagaaagatcagaaatggaaagtagacagcccgtatggcgaaattgatattaccattaatctttccaaaccggaaaaagatccaaaagcgatcgcagcagcaaaaaatgcgaaagcaagcagctatccaaaatgtctcctttgtccggagaatgaaggatatgcaggtcgtgtcaatcatccggcaagacagaatcacagaatcattccgattacgattaacgatacaccatggggtttccagtattctccatatgtatattacaatgagcattgcatcgtgttcaacagcaagcatactccgatgaagattgagagaaacacctttatcaaactgtttgatttcgtaaaactgtttcctcattatttcctgggatccaatgcagatcttccgatcgttggtggttctatcttaagtcatgatcatttccagggcggacattatacatttgcaatggcaaaagctccgattgagaagcatgtgacgattccgggatttgaagatgtggaagccggcattgtcaaatggccgctttccgtacttcgtatccgccacaaagattctgcgcgtctggtcgatctggcaactcatgtactggaagtatggagaggatataccgatgaagctgcatttgtttttgcagagacagacggagaaccgcacaacacgatcacaccgatcgcacgtaaagcaggcgatatgtttgaactggatctgactctgagaaacaacatcacaacagaggaaaatccgcttggtgtatatcatccgcatgcagagtatcatcacattaagaaagaaaatatcggtctgatcgaagttatggggctggcagttcttccggcaagactgaaagaagaactggaacttctggaagaatacattctggaaggaaaagatatcgcatccaacgaaaagattgagaaacatgccgcatgggcagctgaatttcttccgaaatacaaggatatcaacaaagagaatgttcatgaaattcttcagaaagaagttggtattgtatttacacatgttctggaagatgccggtgtttacaaatgcacaccggaaggcagagaagcatttatgagattcatcgaatcattataaaaaaacacataatatacaaaagacagggacttaaggcgcagagctttgagtccctgtctgcatataaaaagcacagacgggacagtagcatattacagtccggaaacagaactgtgttaaaatgacattataaggtatgtttggagaatgtgaaaacagtgcgaaggaaattccggcaaaggaggcatggaatgaagcaaaaatatgtacttacagcagtggcggttgtggctgtcggagcggtggcattgggtacggtcccgatgtgggaagggacgaattctgtgaaacaggaggagaccagaacgagtattattgaggatccggtaaatacagaaacagaaggaaccggtacgccaacgcctcttccgacgacggccccggttactggaatttctcatacggacagttatgaagatctttatgcccaggtaaaagaatggcagaataattcttcatacagtaatgttcagccccgcatcatgactgttgaagagtcagcagatgcggcagggacagactcggctgcttcaaattccagtatggcggcaactatgccggaagaaccgattgaccaggaatatggctttgatccatcatcagaaggtaaagattattctacgaccaccacacaggaagaactgattgatgaggcagatatcgtaaaaacagatggcagctgtatttatgccatggacagtaaaggaacattgcgtattgcagatgcagcgtccatgaaattactctgtgagattaatggagagaacagttccgattataaggaaatgtatgtggatggtaattgcctgcagctgatctgtcagcaggaagattatataacctataaaggcagtatagatcttccgtcagcaaatgcaggtggagaaaagaatacagatggagtccgaaccagttatagtatgccggtaactactgtgacagtagaaacctatgatatctcagacagggaaaaacccaaaaagacaggcgtttatcatcaggatggaagttatctttcctctcgaagaactgatggaagaatgtatctttttacatcatatactccggaagtcggagacagcgcagatcagttacagtactatgtgccaaggtgcggagaagagtatattgcctatgaccatatttaccttccgacaccggaaaaagatttttcttataatggcaggatatatctggtagcaggggctgtcgcacaggagaatccggatcaggcaacagatgttatggccgttgtcagcagcgcaaatattttttatgtcagtgaaaataatatctattcagcaacagaaatctggaatgaccgggaaactcgtacggaaattgtacgaatcggctacagagacgggaaatttaccgacggggcagcaggttctgtagtgggggaacttcacaacaatttttccatgaacgaggcagatgactgtcttcgcattgtaaccactgttgaaggctgggataaagattatagtaatttttccagaagtaatggattatatgtgttgaatgagaaactcaaaacaattggaaagattgaagatctggcagagggagagcagataaaggctgcacggtttatgggagatacaggatattttgtcacatatcgaaatacggatcctcttttcgcagcagatctttctgatccgaagaaccccaggattatgagcgaactgaatatcaccggattttctgagtatctgcatttctacggagaaaatcaattgctgggaatcggctgggaaacagatccggatacaggcaatgtgacggggatgaaatgttctatgtttgatatttccgatccatcagatgtcagagaaacagaccgttttatattaaaggatgtttcattttgtgacgcgctttataattaccatgcgattcttgcagctccgaagaaaagtctgttcgggtttgcttatggaaactatggagataacactgatgtatatgacagcagtgagaagtattattatgcactgctttcctatcatgatcaaaatggatttgagccgcagatgtatctgaatatcaatgacagtgaactttttgcaggctccatgagttatcaggattattgcagagtacgcggcgtgtatatcggagatatgttttatctggtaacagagaagggaattgtttcttataatatacagaaggattatgaacagaccggaacccttaaatgggaagcttaaacgcaataaaaccatgtttctcctgtatttactccttgcagtaatccaacgaatagtctatactagaaagcaattggatgagaatgaagacagagaggtatagattatgaagctcacaactgtaaaagaaatttataaaaacagagaagaatacttgaatagggaagtaactgtaggaggatgggtacgaagcgtacgtggttccaaggcatttggttttatcgtacttcatgatggtactttttttgagacactgcaggttgtatatcacgacaatatgccgaattttgccgagatcagcaagctgaatgtaggcgctgctattatcgtcaggggaactctggttccgacaccggaagcaaaacagccgtttgaaattcaggctgatgaagtacaggtagaaggcgcatctgcaccggattatccgcttcagaagaaacgtcatactctggaatacctgagaaccatgacacatttgagaccgagaacaaacactttccaggcggtatttcgtgtacgttccctttgtgcatacgcgatccacaaattcttccaggaaagaggtttcgtatatgtacacacaccgctgatcacaggaagtgactgcgagggtgcgggagagatgttccaggttactacactggatatgaagaatcctccgctgaatgaagacggtactgtagattacagtcaggatttcttcggcaaagagactaatcttacagtaagtggtcagctgaacggtgagacttatgcacaggcattccgtaatatttatacattcggaccgactttccgtgcagagaactccaatacaacacgtcatgctgctgagttctggatgatcgagccggaatgtgcatttgccgatctggatgacaatatggatcttgcagaggacatgctgaaatacgtgatccgttatgtgctggagaatgctccggaggagatgaacttcttcaattcctttatcgacaaaggacttctggatcgcctgaaccatgtagtggattctgagtttggtcatgtgacttatacagaagcaattgaacttctggagaaaaacaatgacaaattcgattacaaagtattctggggatgcgaccttcagacagagcatgagcgttatctgacagaagaaatcttcaagaaacctgtatttgtgacagattatccgaaggagatcaaggcattctacatgaaacagaacgaggatggcaagacagttgctgccatggactgtctggtacctggaatcggtgagatcattggtggaagccagagagaggatgattacgataagctgaaagcacgtatggatgagctgggactgaaagcagaagactatcagttctatatggatctccgtaaatatggttccacacgtcattcaggatttggactgggatttgaacgctgcgtaatgtatctgacaggtatgggcaatatccgtgacgtaattccattcccaagaacagttaacaactgcgatttataataaggagtagtttttgcatgattagatttattcatctttcagatgtacatctgggggcagtccctgaccggggctgtccgtggagtcatgagagggaagaagaaatctgggaaacattccgccgggtcattgtgggtatccgcaagaatccggtggatttgttgtttatagccggtgacctttttcatcgtcagcctcttctcagggaactgagagaagttgacgatttgtttgcgtctataccggataccagagtttttctgatggcaggagatcatgactacataaaagaagattcgttttacagaaattttgtctggtcacggaatgtaaccttttttgacagggaacagcagtcctgtgtggagatcgcggacaaacagatttttgtatatgggctgagttatgagcatccggagatccgtacaccattatatgatgaatggaaacctcaaaataagcctggctttcatgtgctgctcgcacatggcggtgaagtcggatattgtccgatggattttacaagactggcagcagcaggatttgattatatagcgcttgggcattctcataaaccacatacagtatgtcgcgataagattgtctatgcaggtgcactggaaccacaggatcgaaatgatgtcggaaagcatggatatatagaaggggaatttgacggggaaaccgttaagctgaaattacgtccctttgcacttcgttcttatcagaacctggtccttgcggtagatcagaataccacacagtatgcattggaagatatgcttcggaaggaagttatgaagcggggcggaagaaatatataccgtctgatcattaagggaaaactttctccggataatgtcctcctgccggaacgtcttcacgggctgggaaatattgtggagatcatggatgaatcaagacctgcgtatcagctggaaagcttgtatcgccagtacagggggactctgatcggggactatatcaaaacttttttaaagaaagatctgacagtagtggagaaaaaagcactctactatggccttcaggcacttttgactacaaaagtcctgaccagtgacaggaagagaatatgaagatcaagcaaattgaaattaaagattttggaagtatttacaggcagatgattgttttttctccgaacatgaatgtactgtacacggagaaagaacgaacaagaagagaaatccaggcttttatagagagtatgctgtttggaaggacggatgttccttatgcaggggtactctggtttgagagtggcgggcgcaactaccggctgacccgggatcttcacagagaagaaccttacagtgaacttctctgtgaagagagtggagagcttcttgatgcggaccatatcagtgaggaaaaaatggcactgggtatcagtgaagctgtatatgagaatgcaatctgtatttctccattgaaaggtaataccggggcagaaatcgtacgtgaagtgcagaagcagatgactggctttcagacaacgggagactgctctgtggatctgggtaaaacctcccagaggatcaagatgacaagaaaaggttaccaggtgcaggtggaacgccgcaaaaaggcagaccagctggcaaaagaaaaaatttccgcacagattaaaagcatacgcagagagatccgtgatactgaggaacagaagaatcagcttggagaacaggaagatgtgcttcgcatgaatgaagaaagtaacggatatcatcttcttgacgaacgaatcggggcactggaaacaagaaatcaggcacagatcgcgggaatgtgtatgactgcatttctggcactggcaggggcgttacttctggcactggaggcaggaagtacgattccggcggtactggtaggagttgccggtgttttggcgtttattgcagagctgaattttgaaatgcgtacagtacgtgaactggaaaaacgcaaaagaatgaagtccagatggatcgcaagacagaataagctggaaggcggccgcagcagtctggaggaagaattacgtgaaaaaaatatggaactttccaatctgacagaagaacttcgtgaaatggaagagtatgcgtatctgcctctgatggaagaagttgagatcgatgcgctgaatctggcaatggatacgattgataaactgtcggaacagatgtatcgtcagacaggaaacagactggtgaggacgatgtcggagactctcagaggaattaccggtggtacctgtcatgagctgatggttgatgatgaatttcatatcagcgttgatacagggaaagaagtactgccgattgaaaatctgcgtctgatcatggttgaacagatttatcttgcgatgagactggccgcaggagagcttctgtgtggagcagaaaagcttccggtcatctttgatgaaatgttctgcgcctttgatccgaaaaggctggaaacagctgttttatggattacagggtctgggcgtcaggtgatcataagtacaagcaaaaaacaggaattggatgtgttacagaaaacaggactttctgtcaatgagatttctttatgactgagaagagaataaaaaacaccctgcagatttttctgcagggtgttttgcattgtgctgtgaagaagtgacaggatttatttgtcatactgagccatgtaattattgacgcattttttgattctgtctgcagggttgagcagatggctgacagacatatcatgattcagtgtatcgatgatcagagcaatatatttactcaggtcgcagctgatatagtagtctcttgcgagaagttccggatcctgataaacaaggtttgtagtaagcagtttatcaaaggttccttttgcgtatgctgcgtcgaatttttccattccctctgtgaagagtccgaaagttgtgcagataaagatcttgccggcaccacgttttttcagaagagatgcaatttccagaatactgcttcctgaggaaatcatatcatcgatcaggataacatccttgccttcaagttttggaccgaggaattcataggctgcgatcgggtgacggcctttaactactttggtgtagtcaagacgtctgtagtacatacccatatctacgccgagaacgtttgcaaggtagatcgctctgcgcatgcttccttcgtccgggctgatgatcatgaagtgatcattgtcaatatgaagaccttctacatttttgaggagagccttgatgaactgataggacggctggatagtttcgaaaccatgcagtggagttgcgttctgtacacgtgaatcatgagcatcgaatgtaatgatgttttctacacccatttttgtcagttcctggagtgcggatgcacagtcaagggattcacgtccgatacgtttgctctggcggctctcatagagatatggcatgatgacattgactctgcgggctttgccgccgactgcagcgatggcacgtttcagatcctgaaaatgatcgtcaggtgacatcatgttggtgtatccgctgatcgtgtagttgatactgtgattgcagacatcaaccataacataaatatcgtcaccacgtacagattcactgatctcgccttttccttcaccggaaccgaaacgaggggttttgacattgatgatataggaatcacgctgatatccttcaaaagcgcaggtgcctaattcaggattctcacgctcttttctccattttacaagccattcatttactttttcgccaagggggcggcagctatcgaggggaataagccccagccttcctacaggaagtgttgtcagttccttgttgtttaactgtgccatcgtttattttcctcctaaaaatattttctgtattcggatgtctttgccgataagcttcagcatctggtaattacttgctatccgggaaaaagttctctcggaataggtggctgaaaaatcttcaagtttcagattcgtagatatgatcgtggatttacgatgggaaatacgttcgttaatacacaaaaataactgcgaggagacaaaactgttggtaagctctgtcccaagatcatctatgatcagaagatcacagtcaaggataaaatcatcacccgggtctgtttcggattttctggaaaaagctgtctgagccagacggtcaaacagatcaaatgcagaaaaatacagaacacagtgtgcggttttgagaagctcgctggcaatacagtgagagagaaaggtcttgcctactccggtgctgccgtacagaaacaggttctgtgcgcgcttgtcaaaatcatctacaaagttccgagcagtattataagcccgttttgctgtttcgcgggctgttaatccggttgcttcgttcttcattgtatcagaataccagtcaaaagaaaagtgttcaaagttctcttttttgagaatctctttcagatttgactgtgtgtacagtaattcgacctcggattttttgaaacaggaacatttttgtccgtcaacatagccagtatcctgacagagtggacagaaataatgaggttccagataatcatcagaaaatccgttgctgcgaagaagtgtacggcgttcctgagccagagcggccacgtcttttttgagatcttctacagtatcggattcgcccagcagaagagaacgggcttttctggcactcaaggctgcaacctcctgatcaatctccagcaggcgtggaacacggataaatgcttctttgcggcgttcttccagatcatgctgcacctgggactgacgccggctgtattctctcataataatatcatactgaaaattctgtaaagccacggtactctcctttactgggttactgttcacttcgttcacggtaactttactggttcaatagatgcttctcatattcgtcgaagttgtattctcgctgctggaagttattgaaacggttattggaaggctgtgcaggtttggaggatgctgctttccggtcctgacggcgtttcttgtgttcggtatccagagtatggatgtcatcgatcgtatgtacatctttctttttccagccttccagaatcttgtctgtatactggaagctggcctgacctgtctgaaggacagtacggttgcaggcttcctggatgacctccatggaaaagccataggttcgaagccaggtgtccatcagtgtgatctctgtctctacgggattgcggttggtgattccgagagccttgagaatagaaaaatagtctttattatatcgggagccggactgcttggcttcttccacagaggtaatcccctcctcagcccaggcaagagccaccttctcgatgtagcggatgctcttgtgattgtggcccacgcaatattcaatcagatattcgatcaggtcagcagacatgccaaggccatcatagaagaaaagcatcttttgaatttctgtaggtgaaagtgttttgccaagatattgttcggctacataaagaagctggatgatatcttcgttttgtttcagttcatttacacggtccggagtaagtgcttctgtacggacaacaggctggtccttcggctgttcggaagtaacggaaatctcatcctgcacggcatccgtcggacaggaaggagctacaggagtgagaagagaaattccgcaaagcttattattgtctgtgaaatcaagagtaagaagctgctgtttggcccagtatttcagtgcacggagaatatctctctcggtgcagagaagacggtctgccatctgctccagactgaaagaaaccggagcactggaaagtgcacgtaaaaggtagatatatacttttacaaactctccattagcttccggcatataattatcaataaatgtgttcgataagatcgtaacctccgggagggaggcattatgtaatgtgatcattgccatgaaatatcgctcactttccgatgctgttcatttcatcaggatattacctgtgaacagttatgacttttccgcaataatgcggctgttttggaacacttggattatagcacaacatttttcaaatgagaataggcgatttttctacagaggatttccacaaatgaatgtggataatgtggataatgtggaaagtacatggaggataaaattatgtgcaaccgcgaaaaatggcgaaatttcgtatattatcgcaaaaaatatgaaaaatcgacaaaatattatgtgaaccagttttgcataaaaaatccacatgccatacgcatataaaaatgtgtataaacatgtggataatgtggataacttatttgccaaggagctgttcaccaatatttacaacgtctccggcgcccatagttatcaacaggtcgccctgtgtacaattttctaataaaaagttttcaatctcgtcgaaggtcgggaagtattcacatggagtaccgagttcgacgattttttcctgcagatttctggaagaaatgccaagattatccgtttcacgtgcagcatagatatcagccagtacgacgtgatctgcaagggtaagagctttggcaaattccggaagaagggctttggtacgtgtataagtatgaggctggaatacacaccagatcttcttatgtggataatttttggctgcgtgaagggtggcttcaatctctgtcggatgatgcgcataatcatcaatgatcgttacatcaccaattttgcctttatactggaatctgcggtctgtaccgccgaaatctttcagaccatcaaagattacttctgtagacaggtcaagaagctgtcctgcagcgatagatgccagagcattggatacattgtgaatgccaggcactttcagagaacatgtgcccaggtcttctccgttgtgaagaacatggaaggttgcatggccaagttcgtcataagtaatgtctgtggctgtgtattcagcatcgtgttccagaccgtaggtgatcactttacatggaagattttctgtgatcatttcgtattttggtgtatctgcattaatgatgagagcaccttctgccgggagaagttctgcaaatttgcggaaggaatgacggatatcatcaatatctttgaagaaatcaagatgatccgcatcaatattcagaatgatcccgatggttgggaaaaagctcaggaagctgttggtatattcgcatgcttctgtcaggaaggtctcagactgtccaacacggatattaccgccgattgcaggcaggataccgcctacactgatggtcgggtcacattcacctttgagaagaatgtgagaaagcatggatgtggtcgtggttttgccatgtgttccggcaactgcgatggaagtatcatagttgcgcatgatctgaccaagaagctgcgctctggtcagcatcggaatgcctttttcttttgcgcatgcaaattccgggttatccgggtgaatagctgctgtatagacaaccacctgaacagaatcggaaatattggaggcgcgctgaccatagtaaattttcgcacctttgctttccagaagactggtcagagggctttttttggaatcagaaccggaaattgtaaaaccttcttcaagaagaatttcagccagtccactcatactgatgccgccgataccaatgaaatggatggagagcggtttatgaaagtctatctgatacataataaaaatctccttatctttaatgctttttattatacctctgtcagataaaaatgaaaagtgttactttttatgagaacaatgtgcaaatgtgccaatataatagaagaataattgtgcaaaacatacataaaaagtactgcattgtttttctgaagtaaaaaaaacgtgtgcaaaaaatataaaaaatagaagaaaaaatcaaaaaaattgtaaattatgttcacggatgcaaaaaagtatgatataatggaaaatcataacatacaagaggtgattgcgagatgatgaaaaaagaaatgatcgccatgcttctggcgggtggtcagggcagcagactgggagtactgacacaaaaggttgcgaaacctgcagtcgcttttggcggtaaataccgcattattgattttccattaagtaactgtattaattctggtatcgacacagttggtgtactgacacaatatcagccgctgcgtctgaatacgcatatcggaattggtattccgtgggatctggatcgaaatgagggcggagttacggtacttcctccatatgagaagagtacaaacagtgaatggtatacaggaaccgctaatgcgatctttcagaatctggattacatgcagcagtacaatccggattatgtattgattctgtcaggtgaccatatttataaaatggattatgaagtgatgctgaattatcataaggcaaacaaggcagatgtcacgattgcctgtatgccggttccgatggaggaagccatccgtttcggcatcatggtaactgatggatcagggcgtgtgacagaatttgaagagaaaccggagaaaccaagcagtaatcttgcttccatgggaatttacatatttagctggccggtactcaaagaggcactgatcgcgctgaaagatcagagcaactgtgattttggaaaacatattcttccttattgtaaagagaacggacagagactgttcgcatatgaatacaatggctactggaaagatgtgggaacacttggatcttactgggaggccaatatggagttgatcgatatcataccggagttcaacctttatgaagaattctggaagatctacaccaagggtgatatcattccaccgcagtatattgcagaagatgccgtgacagaccagtgcattatcggcgaaggtgcggaaatctatggcgaagttcatcattcagtgatcggaccaaatgtagtgatcggtaagggcactgtggtacgcgattcgatcattatgagaaatacagtgatcggagaagattccgttctggataaagcaatcgtggcagagaatgttacggttggcaatcatgtaacacttggatgtggcgaagaagcagaaaatgtgctgaagccggctgtatatgcattcggacttgcgactgtgggagaacagagcgtaattccggataacgttaaaataggaagaaatactgcaatatccggagtgacagcgacagaagattatccgggaggaatcctggaaagtggacagatcattaaagcaaaggatggtgagcaggcatgagagcaattggaattattctggccggcggaaataacaaccgcatgagagaactgtcggacaagagggcgattgcagcgatgcctgttgcaggaagttatcgaagcatcgattttgccctgagcaacatggcaaattcccatgttcagaaagttgcagttctgacgcagtacaatgcaagatcgttaaatgaacatttgagttcctcaaaatggtgggattttggaagaaagcagggaggtctgtttgtattcactcctacgattaccaagaataacagcttatggtatcagggaacagcagatgccatttatcagaatattgattttttgaaaaagagtcatgaaccttatgcaatcattgcatccggtgactgtgtgtataagatggactataataaagtccttgaatatcatattgcgaaacgggcagatattacagttgtctgcacaacatgccgggaccagaaagaggtagagcgctttggtgtgcttcgtatgaatgacgatggcagaatcgtggagttcgaagagaaaccgatcgtttcttcttataatacaatatcaacaggtatttacgttgtaagaagaaggctgctgatcgaactgatcgagcgggctgcacaggaaggcagacatgattttgtaaatgacattctgatccgttacaaaaacctgaaacgaatttatggttataagacagaggattactggagtaatatttctgatgcagaagcttattatcgtaccaatatggcatttctgcagccggagatccgtaattatttcttcagacaggaaccgggaatcaaaacaaagatcgacgatcttccgccggccaagtataatcctggggcagaggtgaagaacagtcttgttgcgagtggctgcattatcaatggtacagtagagaattcagtactgttcaagagtgtatatgtcggcaataattgtgtgataaggaattcagtgatccttaatgatgtgtatatcggagataacactgtcatagagaactgtattgttgagagccgggatacgattcgggcgaattccagctataaaggcgaagacggaaaagtcaggatcgttgttgaaaaaaatgaacgctatggattataattgctgaagacagcagcttgtaatctgtaaaataaagaaatgcgtatgaaaatgaaaggggcaggcacgatgaatattacagacgtacgtgtgagaaaagttgcgaaggaaggaaagatgaaggcggtcgtttcgattacgattgatgaagaatttgtagttcatgatatcaaagtaattgaaggcgagaagggactgtttattgcaatgccgagccgcaaagctacagatggtgaatacagagacattgcgcatccgatcaattcccgtaccagagataggatccagacactgattcttgaaaagtatcaggaaatgctggatgcagaaccggaagaggaactggaagaagcagttgaataaatacagtggctgcagacagatcagccgatttttgaatctctaaataagaattaataagatccggggacatgggataaatcctgtgttcctggatcttttatgtttctggaaaaatatgtaaaaaatgaaatgattctgtaataatttagaattttggaggcaaaatctactggatttcagggtataaaaatgtgaaatgttacatgaatgttacaaaaatgaaatgaaagtattgattatttgtgagaatgtgttatacttaacctacaaaatatttaagaggtgtttttatgaagagtaagaaagttctttcactgctgttggcatgtgcagtgaccgtatctatgggaacaaccgtatttgcttccacagaagatcagattgcagctgcacaggcacagaagcaggaagcacaggcaggacttgcgcaggcccaggcgaatatcagcgggctggaaagcaagaaacaggaactggagtcctaccttgcagaactgaattcccaatataatgaacttacagacagtatttcacagctcagcattgaggctgccgagaaagaagaggagcttaagaatgtaaaggctcagcttgaagtggcaaagcagaatgcacaggatcagtacgaggcaatgaagattcgtatccagtacatgtacgagcatggtggaagtactatgcttgaaatgcttctgtcatctgacaatctttctgattttatgaatcaggcaaacaatgtggctacaatttctacatatgacagaaacatgctgaagaaatatgaggagacacaggaagcaatcaagactcaggaaactcaggtcgaagaagagtctgcttctattggaaatcttcttacggagaaaagctctaagcagcaggaagtacagaatctggtggcatcgaccagtgacaatatcaattcctatgtaaaccagatcagtgcaagtcaggaagaagcagatgctcttatggctcaggtgaacagtgcagacagtagtatttcacagctgatggaagaggctgaacaggaaaaagctgctgaagctgcagcggcagaagcagcagccgcacaggaaacagcagaagctgcacaggatgaaaatacagatgaagaaacagatgaagaaacagatgtagtggatgaatctggatatacttcagaagcacaggatacttcttccggcagtgaagataccacatatacagaggatacatcttcaacggacagcagtgattactccgaagatacatcttcagacagtgcaacagctgaagagacgagcagtagttcttctgatacaagttcttcagagaccagctcttccagtcagggaacttaccttggtaattttaaactgacaggatactgtaactgcgcacagtgctgcggaacagctggaaatgcaaccgcaagtggtacaacaccagtggcaggacgtactgttgcaatggcaggggtaccgtttggaaccaaacttctgatcaatggaaatgtttatacagtagaagatctcggaactccttatggccatgttgacatttactgtagcagtcacagtgaggcactgagttttggattacagtatgcggatgtataccagttaaattaaatataagaataataaaaagagctgtctggtttgaccagacagctcagactgtagacaaagccctgcttttgcagggttttgctattgttggaaccgcttaaaaccacgcggatgtgatcgtgtttgagtatctggaaacaaaaggaaagatatctgggagaaagaaacagaagctgcatctgtggaggaaaagggatatccagaaaagatgtgaacatcaggcgcatagaagagggatgcggatatccaggatctgtgcgtggaataccagcaggcttgcctgtgatggatcgggaacagttgtccgtgatccagacaatcacagtttatgtacattccagaatggaaaaagatataactgtgatctttcggcgtcctataatattggagcaagatattttatacgggaactcttaaaaccccttccggcaacggaaaggtctttgctggaggcaaaagtcccttcagtaaagcgtaggatctcatgtgtatatgcggacttaagagaattgttttcagaaatggaactcttaagagcagcataaacacaggcagatatacagtggattacctgcagtgtgggaacctgccatatctggcatggaaaaaagcgcatgactgcgcatatcctaagctacaggcgtatccgccgatatttagccttgtcgcttaaagcgactgaggagcatgtgactttagtcatgtgagatccacaaagcatagaatcaatgataagataaatctgttttattgactccatattttgtacaaaggagagaatgtgtatgagaaagaaaagtaaaagtgcagcgatactggccgtgatcatggcgatgaccctggcaggaagttctgcggtatatgctgaggagaatccttctgcgaaaacaactgaaacggatgataatgaaaaggaagacacaagggcagcagagaatgaacctgctccatgcaatgaaggtgagcatgagcttatagaaagtaaagtcgttctgccaacctgtacagaaagaggttatacgatctacaagtgtaaagcggatggctgtacctacgaagaaaagagagatgagacagctgcgcttggtcatgaactgaaagaagtttccatgcaggaggcgacagcagataaaccaggtgtgatcacatataaatgtcagagacagggatgcgattatacagaactggcggagataccggtcaaaaatacaaatactgttgatggcaaaacagacgatgcagatacaaagacagatgagacgccgggaacagatgccgacagcaaatcagaagatggcaaaacagatgcttctgaagaagataagaattctaatacagaaaatgcttccgtagataaagacagtacttccggaaaaacagaacccactgattcagatacttctgccgatagtaaaaatgaaggtgcagagaaagacctgccagaggaagacctgccagaggaagacctgccagaggaagacctgtcagaggaagatattgatgaagaatatgcttcttttgcatcttccacttcgactgatattgtgacggagtatgatccggaaactgcagttggtacgatttgtgttgcaaagaaagattcggatgatccgacggaaacagaggaagttaccggtatgacagttccagcgggaacgacagagatcaagaaagatgccgatggaaacatcacggatctggcagtttctacagctattgatgaggttaaaaacggattttctctgacaagtgagaataagaaacttcattcgatttctattagtgataagaaaaatccgaaagatcattggatcacgctgagtgccaaagaatctgccactgagctgggaatccgtctccgcaatggaaataataaaattattataacacttacggaaaatgaaaaaccattgaatatcatcaaggtttctgacacagagaaagatgttattttgacaacttccactgccggaacctgtgtgatcaataaggcggttcagaatatttcggtggataaagatgggaagtattcagataagaaaactctgggcagaaagaaccagatcattctgaatgatgtaaatggaagtgctccatatctggaacttgagtatgtgaaagatgagactgtaacgacatctgtatctgcaaaagatgaaaatgctgcaggagttctggaaaatggaaataccaaagtaggaaattctgaatcaaaaggttctgctgcagagaaacagaaagatccggacgaagaattatactggattcagccatatggagaggaaaatcaggagccgattgtaattacagtttataagaaataaaagtgtttttacaacagatatgtctggattttttatgtgagtaaaaaaacaggtcattatcgtccagaacaggagataatgaccttattcattttgtatacaattttacagaacggctaattctgttgtaataagcagattaatacttacccacaacggttgctttgagcagatttgtgttgccaggatgtccaagaggaacaccaactgtaagaacaacgatatctccttctttgacataacctttttcttcagctgcttctgtagcgtgaagaagaagaatctccatgctgtattcctctttggtcaggagtggtgttacaccccagatcaggttcatctgacgccaggtacgctcatccggagtacatgcaatgatctggcatcccggacgatatttggaaaccatgcgtgcagtatttccggaacgggtaactgcgatgatggcttttgcattcaggtcgattgctgtcatgcaggtagcatgagaaatagcggtagttacatttgtagcatgatcttttgaagaagtgctgaactgtttattgtagtcaacatcagcttctgtacgaactgcaattttaaccattgtcttaagtgcttcaattgggtatttacctgcagcggtttcaccagacagcataatcgcactggtaccctgatagatcgcgttggcaacgtcagtagtctctgcacgggttggacgtggattcttgatcatggaatccaacatctgagtagctgtgataacctgtttgccggcactgtatacctttgcaatgatatccttctggataaccggtacgtcttcgagtggaatttcaacacccatatcaccacgggcgatcatgataccatctgcagcttcaatgatgctgtcgatgttgtccacaccctgctggttctcgatctttgcgatgattttgatgtcatgtccgccgtttttctcaaggatatcacggatttctttgacatcggcagcagttctggtaaaggaagctgcaataaaatcatagccttctttaataccaaacaggatatcatcgtgatcttttgggctgataaacggcatgtttacttctacaccagggaggttgacgcccttcttattgccgagaacactaccgtttacgactttacagatgatgtcctgacctttgatcttcttgacttcaagtccgatcagaccatcatcgatcagaatgctgttgcctggtttgacatctttatataaatctttataggtaacagaaacgattttttcgtttcctacgatttcttctgtagttaaggtaaattcttgaccttccttcagtgtgacctttccattttcaaattcgcggatacgaatttcaggcccttttgtgtcgagaagcgcagctaccggtttattgagtcttgtacgaatttcttttaatttatcaatacggcctttttgttcatcatgtaaaccatgagagaagttaaaacgtgctacgttcattccttctttaacgagttcttccagaacaccgtccttatcagtagacggaccaagggtacagataatttttgttttgcgcattcaaattcctcctacttttcctaaaaaatacacctttattctaacacattattttcaatgcacaagtaaagtttttgataaaatacacgttaaatttctaacattttttacgttattgtgagaaaaatatatgggaatcgaaagtaaaataaaagaaaaattccgatgcctgaaactatttatctcagtcgagaagactcccacatcttcaggtggtgagtaatagcaaatttgtctcagtgggagtccaatctccgactgagataaacgctccgcgaggatgcgcagtgattctgataggaatatgtcagcttcgctaaccagaatcacgcgccaagtctcacggacgttcgacttgaattaaaaagtagcagacatcggaatatgtaaaattaaattttataaatttagaaacgagtatgacgattgatgtacttagctttatatttggagtatacgatcgtctgatccttgtacagaccatagtaaccggatacggcataactgatagatacagcaatcaggtaataggacgcaccacggaagccaaacagctcaaatgcgatcaggatggaagtgatcgggcagttggtaacgccacagaaaagggctgccattccggcggctgcacagatggatggggaaagaccgatcaggtgtcccatgatacatccgaatgttgctccgatgcagaaggaaggaacaatctcaccgccacggaaaccggcgcgcatggtcagggcagtgagtacgagcttccagaaaaagtccagcgggcgagcctgaccattctcgacagcaagctcgatcaggttatttccggcacccatataatcagaggtgcgcaaaaagagtgtgatcacaataatgatggcactggctgcgacgatacggatatatggattttttaaaaatttcgcataaagtttgctgacaccctgaagtgccatacagaaaataatactgatggcagcacaggcaacggcaacaagaaccatcttgagtcctgtttcgatggtaagttccgggatattgactacatgaaaagattccggattgatgccaaagcccgccgcaaactttgaggcaataatggatgcaatcacacatggaaccagtgcggcataatacataatgccaacgctcacgacctccatagaaaagactgccgctgccatcggtgttccgaaaactgcggagaaagcagcactcataccgcacatgaccatgacatgacggtcttcttcatcgaggtgaaaccagcttccaagctgattgccgatgcttccgccgagctgaattgcagcaccttcacgaccggcagatccaccggcaaagtgagtcaggatcgtagaaacaaaaatcagcggcgcagaacggaacggtacatcatcctgagaacggatcgttgataaaacctgattggttccgccatcttcctgaccgaatttctgatacagaaaaacaatgatcagaccggaaacaggaagcaagaagaatatccagaaatgctctgtacgatagttggttacgaatttcagtactctggcaaaaaggctgctgatgaagcctacgctcagtccggtcagtactgccagaaccagccatttaataagattggtcatatcatatcgaatgtgatcgatataatagtgcaggttatggatttcttctggtttttttttatcctgtgtgttgttcatagcttccttttattcctgtgtaattccggttacttcgtatccggcatctttgattgtctgacggatcttgtcctcatcaaccttttccggtgctgtgaaaatggttgtgttattttcgtgagaagatacaacgtcttcaacaccgaatgctttcttaatagcttcgtttacatgtgcttcgcaatgtccgcacatcattccctcaacattaactgtaacttttaccatagttttttgctccttttcttttttattataatcattttttacttcaatggaagtagcttggttaatttttttgtccttttttgtgtcgtggatcttaaacaggttcagacgaagggcattggtgacaacgcagaagctggaaagactcattgcggcggcaccgaacatcggattcaatgtccatccgaaaatcgggatccatacaccggcagccagtggaatgccgatcacattgtagaaaaatgcccagaaaagattttcgtggatatttttcagggttgcacggctgagacgtactgcagcaggaacatcgcttaaacgactcttcatcagaacgacatcagcagcatcgatcgcgatatcagttccggcaccgatcgcgattccgatatctgcgcgggtaagtgcaggggcatcgttgattccgtcaccgaccatggctactttgccctgttccctgagtgaacggatcacactttctttgccatccgggagaacacctgcgatgacatcatcaacaccggcctgtgcaccgatcgcttttgcggtgcgttcattatcaccggtcagcatgacaacacggattcccatgttctggagttctttgaccgcctgtgggctgtcttctttgatgacatcggcaacagcgataatgccgaccagtttaccattccgggcaaaaagcaggggtgtttttccctcttctgcaagtttttctgccttctgggaaagggtggcaggaacgtttacctggctgctgatgaatttcatgcttccaccgatcagagtttcctgatcaagtactgcagagagtccgttgccgggaagggcatggaaatcagaaacctccggtgctgtaagatgttgttcttcagcatgtttgagaatcgctttcgcgagcggatgttcactttttttctccagggcaaatgccatggtgaggagttcctgttcggagattccatctgcagggagcagatcagtaacttccggctggccgctggtgatcgtaccggttttgtccagggcaacgatctgaaccttgccggcctcttcgagagaaacggcagttttgaacaggataccattcctggctcccattccattgccgaccatgatcgctaccggagtggcaagtccgagggcacatgggcaactgataacgagaacggagataccgcgggcaagagcatagccaaattcatgtccggtcagaagccagatgatcgtggtaacgattgcaatcgtaataactgccggaacaaaaataccggaaacacggtctgcgatcttggcgatcggagctttggtagcggcagcatcacttaccattttgatgatctgggagagagtggtgtcttcgccgacacgggttgcttcgcatttgataaatccggactggttgacggttgcggcggaaacaagatctccggctgctttgtcaacagggatgctttcgccggtaagggcagattcattgacggcgctggttccttcaatgatcacaccatcgaccgggatattttcaccaggacgtacgacaaagatatcacccttgtgaacctgttcgatcggaacggttacttcctgatcgcttctaagaacaatggcggttttcggggcaagtttcatgaggctcttaagagcatcggtcgtttttcccttggaacgtgcttcgagcatttttccaacagtgatcagcgtcaggatcattgcggcagactcgaaataaaattccatcatgtagttcataacggcagcggaatcaccgtctacctgtgctcttgtcatggcaaaaagtgcgtagacactccatataaatgaggccatggagccgagtgcaaccagtgtgtccatattgggggcacggtgccacagactcttaaatccgctaatgaagaatttctggttgatgaccatgacgattccggcaagcagaagctggacaagtcccatggcaacgtggttatcgttaaaaaatgccgggagtggccagtcccacatcatgtgtcccatggagaagtacatcagaacgagtaaaaatccgatggaagcgatcaggcggcgtttgagaaccggtgtctcgtgatcttccagggcttcctcggcttcagacatggaaacctgttctttatttgcacccttgagtgatgcgccgtaacctgcctgctctacggcagtgatgatgtcatgagaggatgcggttccttcaactcccatagaatttgtcagaaggctgaccgagcaggatgtaactcccggcactttggatacggccttctccacacgggaactgcaggcagcgcagctcatcccggtgacgttgtattgttccattgtattacctcctatttcattagcttctgcagagttgcaaccagctcatcgatggtttcatctttaccttcgcggatatcacgagccacacaggtacggatatgattcgcgagaagttctttgttaaaagaattgacggcggcattaacggcggctgactgaatgaggatatcgttgcagtaagcatcgttttccaacattcctatgattccccggatctgcccttcgatacgtttcagacggttgatgagtttcttgcggtcagcttctgaacggtcggtgtgcctggtacagcagcaggcaggagcggatggggtggcattatcattgctgcaacaagatttttcctgagcagctgcttgttcctttataatttcttctgtctttgtagaggaactggcattaaagttattatgatccataagcaaacttcctttcgttcgagatttattatatcagatgtgagatgactcccacctcgcagcaagaatgccgatggcattcctgaatcgcataccctacaggggtatatttactatacttgtaatatataccccatgagggtatatgtcaagggaaaatataaaaaaagagggatatcagggaattataccccgataaccctcttgctgataagcaaggataccccggcggtcagcgcttccgcaatccagaaagcgttccatacaccaacggctccgaagaaatgactcaggataaatgctgccggaaggataatgaccaggtacctgcagagagagacgatcaatgaggcagttcctctgccaagtccctctagtgcaccacatgctgtgacggatacagaagagatcaggaaacctgcacagatgattcggagtgctgttttgcctgcggtaattgtctgaggatttgtggtaaacatgccgatcagctgtcccggaattgtcaggcagatgattgttccgatcaacatgatcacaccactcatgccaagtgtgacgaagtagattttttttacacgtttatgttcaccggcaccatagttgtatccgatgaccgggcgcatgccctgtacaatcccgcttgccggaagatacaggaaagtctgcagtttgtagtaaattcccagaatcaccacataactctgggaataggctgccagaagtccattcagtgcagaaaccaggacagaaggaagtgcaagattcagtgctcccgggataccgacagagtataatcttgctgccagagccatgtccggatggagatgtctgcggctgagttttacctggattggctgcattttgtaaatgatcagatagaaaacaagattgaatacctgaccaagtccggttgccagtgcagcgccttcaatacccagtgccgggaacggaccaaggccaaagatcagcagcggatcaagaatgatattggaaacacagccgaccagaagcccgatcatcgtaatcttcattttgccaacaccctggaagatcttttcgtaagcaaggttaagcgtatttatcgttgcaaacagaaaaacaattgtagaataacggattccaaggtcaatgacatctgtatcaccagtaaaaagtgccagaaatccaggcatcacaaggatacaaccgattgtcagaattacaccatgcagaccggacaatgcaagcccgtgtgtggctgctttgctggcagtctctctgtttccggcaccaagacagatggcaatctgtgaactgataccaattccaaaaccaatcgcaatcgcattggcgaagttttggacaggaaaaacaagcgacagcgcggtcatggcattttcactgatttgtgcgacaaagaaactgtccacgatattgtacagagaatttacgagcatcgaaatgaccattggcaaggccatggacatgatcagcggaaagaccggcttttctttcataaatgtgtcgttcatagaaactcctttcaaataaaaacatctgcaagtgccggtatttctgaaaaatctgtatcggcggagcagacataaaaaaacgccgcacaactaccgcaatgggtaattgtgtggcgaaaaatggtcggaccagaaaaatccacactatgttttggaaattaaaattgttgtaaacatgaaaaaaacagaatcgttgtttacagacacagattgtagcatataaataagaagaacgtcaataaaaagattgtataaaaaggagatatccaaccctcatttggatggacaggtatctccttccgggaaatatccagatcacggatcttctgattcgtccatggatttcgctgctggagggtgatctcttttgaaacgtatgggtggagtaatgtattaaatataaacggaatcgttcgcagattattgtatacaactctgtacaactggccttcttgcggggatttcaacaatgtgctacactaaagtatgatttgagatgatgaggatgaaaatgaattaagaagaaaggaagcaggtgtttcaaaggaaggaaacacgcggaaagtagaatattatgaaaacacttcttacattacagctcacgatctttctcctcgtagctgtaggatttttgatgaaaaaaatacatatcatcggaccacaggggcaaaaaaacatcaatgaccttgttatttatctgatcctgccgtgtaacattcttcatgcatttacgcagagtgcggcagatggaaattttatgaaatatctggaaatccttcttatatctataggtattcaggtattctgtgtgatttatggaaaagtgatgttccgaaaagaaccggaaggacgatataaatgtcttcagtatggaaccatctgctcgaatgcgggatttcttggaaatccgatcgcagagggaatttatggcgcagaaggtctggtgcttgccagtgtttatctgattccacagagaatcatgatgtggtcctccgggttggctgttttttccggaagcagtgataagatgaaaacactgaaaaaagtcgtaacccatccgtgtattctggcatgcgttctcggaattattctgatggttacaggacttccactgccacttggacttgacggtgcagtaacggcagttggaaactgcaacactgctatgtccatgatggtcattggcatgatccttgcggacattgatctcaaagatttctgggactggacagttgtaaaatatactgtacacagactggtcgttattccggcggtcgtttatattgtatgcagtttcctgccattgaataaaacagtccttggtctttgtgtgcttctggcagcgatgccggcgggtgcgacaaccagtatcctcgcagagaaatatcaggtcgattctccgtttgcaacgaagatggttattttttccacgctgctgtcattgccgacgatctgtctgtggagtatcttcctgcagtaggagaagtagaagagaatttgtaataatgcatagagttctatatatggatatgctaaaatagaacaaaagggagaggcaggtggaaaccttaagcctgaaaaatatgctggatgaaatatttgcagggttactttcatttacagaagatgccggagctgattgtgccagtgctcaatgagatatttggaacaaattatccacttgatgttccgttggaacagctacgaaatgaacaccagacgctgaatggtgaaaaaattactgattcatacttcagaattggaaaaaaaggttatcatttcgaatgccagagtacaggtgactagaaaatggtgatccgaatggcggagtatgattttgcaatcagcattgaaaacgtgaaaaaagaaaattaataaaagtgaaacagcgataatcatatttggaatatcccagttcttcatccagttcctgatcaagggcgccttccaaaacgatagacatcatatcccgcataatggaattaacatctgttccatcttttacttttacattgttttctttcaggtagtttcccatgagttctctaagcgctgctttttgtggtgaatccttttttcttgccataaaataaacctccaaactgagtaattctatcttacatcagtttgaaggtttacacaaactttgggatactccccctgcatcaattgttcacctataaagtgaatctaatgtaagcagcaaaacatcttcatcagataatgagttgaaccaatctgtatatcctgatagagaaaagaaaatatattttgaaattttgtatttattggatataagagttcctcttctgaccaaggtttcataaatacccttgtcaattttttcgtttttgaacttacattcgccaataactgcttttttatctatatcagataaggcaacgatatctatatcggcagattgtgctcgtatagaaccgtttttatctgtaatattttctacaccccaccaggttccgactgaagtaacgaaacaaccatatgcatcggttattccctgattcagagtatagtatcggcacatttcttcaaatacagaacccataaatgaatgtaagaatggtttgacagctttttgataataaagtgcaccctgtcccatttcaattacactggttgcttttgggataaattcgtaccagaatttgaacatataatcttttagaacatattgtgttttctttttgtttttttcttctgtgatacatttctttttttcaattaacccaacactgattaatttttctaatgagtataagacagttggctctttctcgttaatttttccggaaatggtattaagtgtatttactccggaggcaatctgttccacaatattatttacgagtgatatatcagaaaattcctgtgtcagtaagtttctggtttcatcatataaataaccatctgtcctgaaaaataatcttataatgttctcgtcaatgttttttttcggatcgatcatggaaagatattttgcaacaccgccagtaatgccatagcagattgctttatcttcgtttgaatagtcaggaacaaatttggctgaatctaaataattaaatgcttctaattttatctgtgaatcacgtctcccaaataacggacttttttcactgagcactttattttccataaagcttaatgctgaaccacataaaattattttcagatttttgtcattccagatcgtgtcaatatatttctgtagaatagataaaagagagtcatctttttcagcccagtatggaaattcatctattacaagtactatcttatcattagctatatttttatcaataaaatcaaaaacagcttctatactgttaaaactgatgttttcaattccgggcatgaataaatctaacacttgtttagaaaatagctccagatttctggtttttccgatttttgttgccgtataaaaaacagtttttttatctttgacgaattcggtaataagagtagactttccaatacgtcttcgcccatagataacggtcatgccaatgccgtctttggcataaaattcttctaacgatgccagctcttgttctcttcctacaaacatatgaatagccctccttttatttaaaatagttttattaaaatttattttattaaaattgatttgaataaaaataagatagcacatactattatatattacaagtagtttttgcagttttattattgaaaatccatttggcgaagggagaatgcaggagaacgtgagacatttacaaaagatttgacagatagtgtataataagaccacttggaatgttttatgtgaaggagcagtagatggatatctatcagatcttgacggaatacaataatccgtggtcaagccgggaaatcttttgtttctcgtgtattatggtgatcgcggttattatgatgatttatttattacgtaaggaaaaaatgaataagctccaggcagctgcgattttggcagaactggtcttccttgggattgtgtttggttctacagtatttacaaggacgggttcggtccggcagtatgaactgattccattctggtcatggagtgccatactcaggtaccatgatatggaattgctgaaggagaatctgctgaactgtattttgcttttaccggcgggagcgttattgcctttgatcatgaatcataaagtaaaatggcagcatgcactggcatttggtgtggtggtatcggcggttattgagagcagccagctgatcatgatgcgtggattatttgaatgggatgatatgattcacaatgggctggggtgtatggttggtgcggttcttgtgaattggatgattggattttttggaaaaaaggatgaaagataaactttcccctatcccccccacaggcttgtggcggggactttttttttatatactaaaagaatactattttaagcggagaaaataattatgagtgatctgaaaaatgaaattcatgactactggacgaatcgtgccaggggttattcggaatataatcagcaggagatggcggatgcgaggcggacgatgtggagagacaagcttctgagtctgctgagggaggcgttcccggaacgtgaactaggggaaataaaaatccttgatgtaggaacgggccctggattttttgcgatccttcttgcggaggccggctatcaggtgacggcggtcgattatacggaagagatgttaaaggaagcgcagagcaatgccggtggattggcggagtgtatagtgtggaaaaccggcgatgcgcaggctcttgatgtggagaacaacagctttgatgtggttgtgacgaggaatgtgacctggaatctgccaagaccggatctggcatataaagaatggcttcgtgtgctgaaaccgggcggagttctctataattttgatgcagactggtatggacatttatataatgaagagaaacgcagcggatacgagaaggatcgtcagcagacagaagagcagaatgtagaggattactacagtggcacggacatcgagaagatggaagagatcgcgcgccaggttccgctgagtcgtctggaacgtccaaaatgggatcaggaaacgatgcgaaagacaggatttctggatgtttcctgtgacgaaaatgtctggaaagaggtctggacggaggaagagatcatcaacaatagttcttctccaatctttcttttgacaggcagaaagagagatgcgtttcatctgaaaaatattgccgtaaaaccgggtgagaagtggaacggagaactggagcttgcaaacggggaacttaaatttccgacaacagtatttcatggacatggaacaggtaagacgatgctgatcactgccggtgtgcatgccggggagtatgtgggaatccaggcggcgatcgagctttcacaaaagcttaagattgagaaggtcactggtacgatcattatcgtgaaggtgctgaatcgtccggcttttgaggcgcgtaatggaagtatggggctggcggatgcaaagaacctgaaccgtgaatttccgggaaacccggatggtacggagatggagcgtctggcatgggcggtttcgcaggagctgcagccggtggctgatctttatattgatctgcacagtggagatgattatgagaagctgactccgtatgtgtattatgcgggagctgcaccggaggatgtggttaaggtttctcgtgagatggcggagcaggtggatgtgccatatatggtaaagtccaacgtggcttcgggtggttcgtataattatgcggcttcgcagggaatcccgagtatcctgatcgagcgtggcggcatgggcgactggaattatgaggaggtccgttcgactcgaagagacgtccggaatattctgtgtcacatgggaatctatcagggattgaaggattttcgtacgtattatccgctcgaggtggcagatgtgcgctatcaggatgcggaagaaaacgggctctggtatccgtttaaaaaggtcggtgacatgatccaggagggcgatatcctgggtgaagtccgtgactatgaaggcaaggttaaggaagtcagtgaggcggagtttgacggggtgatcctgtatcagacgggcacgcttcaggtggttggaaatggtccgatggtgacctatggacgtattgtaagtcgctatgatgagcgcaaagagcgtatcgttaactactgggaaaagcgaagcgacagctttctggaacagaggcgtgcggagcttcacagtgcgatggcggaccgctggatgaaggagattcaggcacagcttccgaaagaaaataaaaagcttcgtatcctggatgtgggatgtggagcaggattttttacgattctcctggcaaaggctggccatcaggtgacaggtatcgatctgacaccggatatgatcaagaatgcaaagcagctggcagaagaggagcaggcagagtgtgagtttgcggtgatggatgcggagaatccggagttccaggaaggtacgtttgatgtgatcgtttccaggaatctgacctggacgctaccgcatgtaaagcatgcatatggagagtggcttcgtgtgctgaaaaagggcggcgtgctgctgaattttgatgcgaattatggaattacagacttctcgaatgtggaggatctgccggaaaatcatgcccacaatatgcttggaaacgagatgatgcgtgagtgtgaggagatcaaacggcagcttccgatcagttcttacagtcgtccggcatgggatctggagacgctgggagcaatgagtctgaaggagttccatgtggatctgggcatcagcagcaggatctatcttgagaaagatgagttctataatccgacaccgctgtttatgctgaggacggtaaaataatatggatttaaaacaattacagtattttgtagtatgtgcacagacgggttctttcagtgatgcagcgaaggttctttattctacgcagccgagtgtgagcaaggttgtcaaggcgttggagaatgctcttggaatgcagctttttgagcggcttccgagaggaatacgcctcacagtgcagggacagaaagtttatcagtatgcaagcagaatcacaaacgagatcagcgctttggagaatatggcgtcgcacggaatgacaaaatggatccgtgtttcgctgaatccgagctcctggtttgcgaatcagtttgtggatttttataacgaaacttatgagaaaaactatcattttcagctgactacagcaggtgttcggagcgttatggaccgtgtcagagactatgtggacgacatcggttttgtgtatatcctgagtcagcagaaggagaattttctgcatgaaatatcccggaataagttgcagtttgttccgatgtatgagacggatgtggtgttttatccgggacgaaagacggaactttatgattctggacggagcaaagttgagctgcaggatctggagggagtccggtttattcagaactatcaggatgagttttttgacattggttctgtgcatgaggattcttttcagtggaaggctattgacatttccgtactgacaaacagtgactacattatggaaaagatgctgaaaaacagcagggtttccaacgtgagtggaagctatctttcagagaataaaacgggtacaacaccaggaattcctctggatatgggggacagcaaggtgctcttcggttatattgttcataaaggagaaaaaattgacgaaagtgtacaggaactgattgattttttggtggcacgactacataaaagttaaaacagacttattccataatgtgcaagagatattcccttttggaatagcacataaccctccctgggggttgtgtgcttttttttgatttgttagactttatttaacgaattaatgtgcggataatttgatttatttcagacagacataaaggagtactcatgattaaatacatttttaaaaggcttcttcagttgattccgatcttagtcgggatcacttttttgtcttttgccatgatgcgtctggcaggcggcgatgctgtcacgtatatgtatgagaatgcaggttcggcagtttctcaggaagtgattgacgagacaagaaaagaatatggtctcgaccagccgtttcttgttcagtatgcaaagtggtttgcgggaatggcaactggagatatgggaaagagttacgtatccaggagggatgtctatgaaactttcatagagaaacttccggcgacgatcatgctcacaatatcttctgtactgcttacaatgctgatcgcaattccactcggcattctttcagcggtacagcataataaatggagcgattacctgatacgtttcttaagttttattggaaattccatgccaaatttttttgtagcactggtgttgatgtattttctttctattaaactgggatggtttccggttattacaacagagaataaattacagagtctggtgcttccgacgctgacgctcgcaatctccatggcatccaaatataccagacaggtgagggcaacgatccttgaagaactgaataaggactatgtggccggagcaaaggcaagaggtgtgagaggaagtgtaattatatggaagaatgttatgaaatcttccatgctcacgatcattaccctgctggctttatcaataggaagccttttgggtggaaccacgattgttgaaacaatttttatgtgggatggcgttggtaaaatggcagtagatgcgatcaccatgcgagactatccgatcattcaggcatatgtggcatggatggcgattatttatgtggttgtaaatctgatcacggatatcatttatcattacctggatcctcgagtaagattaggaggtgacagagcatgagatgtataaataacacagataaaaatgttactgtccgaaaacagaaaatccgcaaaaatcatgtcagagaaaaactgatcttttttacaatgctggcactgatcctgcttcttgcagcagcttttgtccggaaactctgtccatatgatccggatgtacaggatcttctgatggcacagaagccacccagtgcagaacatatactgggaaccgaccgttatggaagagatatgttttcgcgtgtactggtgggaagtacgaccagtatttatgcaactctgcttcttgtagcaatcattactgtgcttggaactgtgattggtatcatctgcggatggtgcgggggaatccttgatacagtgctgatgcgcatatccgatctttttcttgcattcccaagtcttgtttttgctcttgcagtagcaggtgtactcggtggtggtattcagaatgcaatcatagctctggcggtgatcggctggccaaagtttgccagacttgcccggggactgactcttgcacaaaaagattcgccgtatctgatggcagtgagactgtcaggaagcattacacccaagattatgttcaaacatatcttaccgaatattgcaggtccgatactggtcacatctgtacttgatattggaactatgatgatggaacttgcagggctttccttccttggacttggtgtacagcctccgatggcagagtggggaagcatgatcaatgatggaagaagtatgcttcagatatcaccatggatggtgcttgcaccgggacttgccatatttataaccgttatgatatttaatctccttggagatacactgagagattttatggatccaaaagaaagagcaaagagataagcatataaagaaaggaaacaactattatgaagaagaaattaattgcagcgattcttacaggagcaatgctggtggcaggaatgtccacaggtgtatgggcagagagtgaaaagtcattcgtgtatggaacaaccggatacagcgaggagatgggagatgccggattaaatccacatgataattattccggctggagtgcacttcgctatggagtaggtgaaacactgtttaaatacaatgacaacatggaagtagagccatggcttgcaaccgattatgaatttgtggatgacacaacagtaaagatcacactccgcgatggtgtacagttttccagcggacgtaccatggatgcggaagcggttaaggaatgtctggaagacctgatcgcagttcatgatcgtgcaccttatgatctcaagatcgatcatattgaggcagacggcctgacgcttactatttatacggtggagccatgtccggcaatcatcaattaccttggagacccatatggagcgatcattgacatggattatggaattcagggcgagggcggttctgccaatgttgccggaactggtccatacattgctgcaaacgtcactccaacccagatcgatctggtcaagaatgacaattactggggtggtgatgtaaaggtagacaaagttacggtgaagtcctttgcagacggaagtgcgctgacagcagcattacagaccggggatattcagggaacatatggactgcagtatgacaactatgctttgttcgaaaataattcggactatacgatcaattcctgtgcgaccagccgatgcttttttggacaatttaatatggaatctgagacaatgaaagaccagaacgtccgcaaagcagttgagatgggaatcgacaaagacggattctgttctgtgatcatgcagggacgtggagttccggcaaaagcagcattcccgagcagcttttcttatggaaatgatgcagtggaaaccgtttcctatgacccggatggtgcaaagaaactccttgaagagtcgggatggacagacactgacggtgatggatatgtagacaaggacggacagaagctcagtatcaactggctgacttatccgacccgtctggaacagccgaagcttgctgagtatgcacaggctacgttgaaagatatcggaattgatgtagttgtaaacaatacatctgaccacatgacaattgcaaagagtggagattttgatgtatatgtaagctcaacaactacagcaccgaccggtgatccggaatacttctttaccagtacagttacaggtgccaaaaactatggaaaatatcagaatgaagaagtaacaaagttgacagaccagcttcatcagactttcgacaaagatgaaagagcaaagcttgcagtagaactccagcaggatatcctggatgatgatgcattctttttcgtatcacatttgaacatgggaatcgtgacaaaatcaaatgttacaggaatggcagcacatccatgtgattattatgagatcactgcagatctggatgtagagtaaattttatggttgtttgcagcagctaaattctgaggagaatgattgattatgagttcattgcttcgtgtagagcatgtgacaatttcttataatggaaaaccggtggtccaggacgtaagttttgaactgaagcagggcgagattctggggatcgtaggtgagtctggaagcggcaaaagtacgatcataaaagcaatcatgggacttctgggagaagaaggtctggttacaagaggcgatatctggtacaaaggtgaaaatcttacagacatgagcgaaaaaaaacttcgtaagcttctgggaacagagatcggaatggtatttcaggactgtaaagccgcattatgtcctgtacggacgattggagcacagatatacgaagcagtgtctgaacatgagaaaatcagcaaaaaggaagtacggaaacgtgcaggagagattatgaaaaaaatcggtctggatgacagtgaccgtgtgctggacagctacccgtttgaactttcgggtggaatgaaccaaagagtgggaatctgtacggccatgatcctgcatccgaacctgcttcttgcagatgagcctaccagtgcgctggatgtgaccgtgcagaagcaggtggcagaagaacttctgtttatgcgcaaaacatacaataccgcgatgattcttgtaactcataatatcggtgttgtaaggatgatggcagacagaatactggtgcttcagaacggacaggcaagggagtatggagaaactgaggctgttctggatcatccgaaagatccgtatacaaagaaactgatgagttcggtgcttcatctgaagcgggcagagaatcaggaggtgcgttgaaatgacagacattatcctgaaagctgagcatctcaaaaaagtatttatatcaggaaaaaagtccatgactgcagtggatgacgtaagctttgggctggaacggggagaatgccttggaattgtaggtgagtctggttccggcaaaagcacgattgccaggatgctcacacatctggagccggtgacagatgggcagattttccttaagggaaaggacatcacccatgccagagggaagactctgcgtgatatttaccaggatatacagatggtctttcagatgccgatggaatcgtttgacccgcgacgtacgctgggtgatggaattggggaaagtctccggaatatggggataagccacagggaaactcgtgaaagagtggaaaatcttctggaaaagtgcgggttggaaaaggaatttgctgaccgttatcctcatcaggtcagcggaggtcagtgccagagagctgcgattgccagggctcttgcagtagatccggaaatcctgatttgtgacgaagcaaccagtgcactggatgtaaccgtgcagaaacagatactggaacttctgattgaactgaaagagaaggaaaatttgtcatttctgttgatctgtcatgatcttgcactggtacaggcactttgtgacaaagttctggttctttatcatggaaagacagtagaatacggaagtccggatgagatcattgatcatccgaaaatggattatacgaagagactgattgagtcggttttatagggcaattactataataagtagcaaataatagttggagggcaggaactatggtagtcaatgtttttctgtttgatgattttgaagtgatggatgcgtttggtccggtggagattttggggcgtgtaccggagcatttctatgtgcgttttatttctctgcgcgggggtctgatcacaggaaaacaggaaataaaaatttggacagaaccgctgaatccggtggagattgaggatattttcctgatcccgggcggaacgggagttaagagctttcttcatatggagggagaaaatggccagcagctgctgaaacaggcggtggaggaggcatctttttgcatgatggtccagaatgcctctgcgctgttggcaaggacggggcttttgttccacagacaggtggccgattatgcgtatgatgaaaactggaagaggatgtttacggttggaattgattacatagacggtgagaaatggatttctgatggaaaatattattcctgtagtacgacggtggctgcaatggatatgacgcttgctctgatcagtgataatctggatgtttctgttgcagaaaagattgcagaagagattggatattcctgggacagcagtttctgagcggagtgtgtgagagattataaaaaaagtacttcccgcggatttggaagtactttttttatgggttgaattgaatgtgcatcaatatgtggaggtcatgcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagtactttttttatgggttgaattgaatgtgcatcaatatgtggaggtcatgcactttatttgggagataacacagttctttgtgttgtttatattttaacaaaacagggggtaaaaacaagcctcccggggggattattacctatgaaaaaaagaacgttattcatgctgtatatgaatatatagatatcccccccgggcggttgttgacactttgacacagtgataaaatacagttaattacgaggtgcgcgccgaataaaataaagttttcacagggaaaggaagtatatctatgcatatacctgagaactatttaagtccgtcaacatgtgcggtaatgacggcagccatgcttccggtatggggatattcaatcaataagatcagaacggagatacctaaggcaaagatgccgttactgggaattggcgcagcattttcatttcttggaatgatgtttaatgtaccgcttccgggaggtacgacaggacatgcggtaggtggaactcttatcgcaattcttacaggcagtccggcggccgggtgcatatcggtatccattgcgttgctgatccaggcactgctttttggagacggtggaattcttgcatttggagcaaactgtttcaacatggcttttgtactgccgtatctaggattttttctgtatcagttacttctgaaaaagacaggcaagcgtaaacttagcgctgcgattggtgcatatgtaggaatcaatgcagcggcattctgtgcagctgttgaatttggaattcagccattgctgtttaaaaatgtagcaggtcaggcgctgtattgtccatatccgttaagtgtgtccataccggcaatgatggtcggacacattacgttatttggcctggcagagattgtattaacagtagttgtattggcttttgtagaaaaagtttcacctgcagcactggacaatgttccggagaaatcttcgttcaaaccactgtacatattaattggagcacttatcgttctgacaccgatcggacttctcgcaacaggtactgcctggggagaatggggcgtggatgagatggcgacacttgtcagtggcggcactcagttgggatatactccgtctggtatggagagtggatttgagctttcaacactgttcccagattattcgatgacaggtatgccagaatggacaggatatattctgtcagcagttgttggagtagctcttctggtaattttcttcaaaattatttcttctcttatgaaggataaagttgattttaaaaagaaagcagcataattaataatgaacgattacagaacagaaaaaacagaaattcctgaatggatgtgccagcaggaagaatatactccgtcgaaggataaagaagcatttttgactaagagcacaaagtctgttttgtctgtacttggaaagctaagatttcatgaagggaaggatggcagattttctgctactccttctcttaaattattttatacgctaatatatattatactgacagcatctgcgagaaattatttatttgtattgatcatgtgtgcagcagtaactgtcagactggcattttttccggcagcagcaatacggcaggttttaagtgaaacagcaggtgcagtaatgatttctgtgtttcttcttttgccggcagtttttatggggaatcctcagacactggcgaatattacagccagggtgtatgtatcggtaactttggttggaatattgtcggctgggacatcctggaataaacttacagccagtatgcgaactttccggattccgtcactgtttatttttacactggatattacgctgaaatatatttctgttcttggagaaatctgcgtggatattctgacatctgtcgggctcagatcggtgggaaaaaacccggacaaggcaaaatctttttccggagtacttggaatcacattcctgaaatccagtgagatgtcagaagaaatgtatgcgtctatgtgctgcaggggattcacaggagaatatcagatgagcaagaagtacagactttgtttgcaggatgttttgggtattctgatgatggtgtgtggtatttgcctgtttttatatttgaatgtaaatatgtagtccgagatttttaaagaaagggaagaagcatgatcacacttgaaaaagtatgttttgcatatgaacatgaagttgcacttcgatatgtgaatcttcatatcgaaaagggagagtcactggtaattcagggaccgaatggatgcggcaaatcaacgcttatcaaattattgaacgggattatttttccatcagaagggcattatttatataaaggccatgagattacagaaaaagcgctgaaagacaggcagtttgcaaagtggtttcaccagcagatgggatatgtttttcagaacgcggatacacagctgttttgcggaagcgtggaagaggaagttgcgtttggaccgattcagatggggctttcggaggcagaagtcagggagagaacagaggattgtcttcgtctgtttggaattgaaaagcttagagaaagaccaccgtatcatctgagcggaggtgagaagcgaaaggtttctcttgcatgtattctttccctgaatccggaggtgttgatcctggatgagccgcttgccggtctggatgagaagacgcaggatatgcttctggattttcttaaaaactttcataatgcaggaaaaacgctgatcacgatcacacacaatcgccagcttgcggaaaatctgggaacgcgttttgcagttatgaatgaagagcatgaattgaaagtattataactgttcagaaggtagtaatattataaaaaaaggtacttcccgcggatttgaaagtactttttttatgggttgaattgaatgtgcatcaatatgtggaggtcatgcactttatttgggagataacatagttgtttgtgttgtctctattttaacaaaatggagggggaaaacaagcctcctggggggataatcctgcctgtaagcatccccagacacagtcgtaggggaggtgtggcgcagaagataatctgcaaatgagaaaaattgcgaatgcggtcacaaatatagagcagagataatctacaaatgggaaaaattgcaaatgcggtcacaagtatagagcagagataatctacaaatgagaataattgtgaatgcagtcactggttcggaggggaagataatctgcaaatggaaaaaagtgcgaatgcagtcacaagtatagagcagagataatctacaaatgggaaaaattgtgaatgcggtcacaagtatagcgcggagataatctacaaatgggaaaaattgcaaatgcggtcacaagtatagagcaggagataatctacaaatgagaaaaaaaggaaatgtggtcacaagtatagcgcaggggtaatctgcaaatgggaaaaattgcaaatgcagtccccaggacagctgtagaaggaaggtacagagggaagcgtaattcgactctgacaaaaacatataaaagacacctgttgacaatcatggctggtatgggtatgtttaacataatatatagcaagaattctccttcctctacaggtgggagatgaattgtaaaaaataaaaaagaacatttgtttggcaacgcaatccatggtataatagaatcagtcgataagataaggtaattattcaaaaaagggctggttttatggaaaatatggatcacaatgcacattcagtgtacttgatgtattatcacttgattatggtggtaaaatatcgaagaaaagttatcaatgatccaatttcagaaagagcaaaggaaatatgggaatatattgccccacggtatggaattgttttggaagaatggaatcatgatattgaccatgtgcatgtaatgtttcgagcacagccaaaaacagaactcagtaaatttatcaatgcttataaaagtgccagcagtaggctgctgaaaaaagagtatccggaaatccgggaaaaactttggaaagaagcattctggagccagagtttctgccttttgacggcaggaggggcgccagtagaagtgatccgtcaatacatcgaaacccagggagagaaaaagaattgaacatagcatatcgtttccggatttatccaacagaagaacagaagatactccttggaaaaacatttggctgctgtcgttttctgtacaatcagatgcttaatgacaagatccaggagtataaaaagtcaaaaacgatgttaaagaatacaccagctatgtataaaaaaacgtattcatttctgaaagaagttgattcgctggctctggcaaatgttcagcttcatctggagaaagcatataagaacttttttcgtgatccgaaggttggatttccgcgtttcaagtcaaaacatcattccaaaaacagctacacaacaaatgtggtcaacggaaatattctggtagaaggtaaccggatccggcttccgaaattaaaatggatctccatgaaaaaacacagggagcctgcagaaaactgtcgtctgaaatcagtgacagtcagtatggagtcatctggaaagtattttgcaagcctgctgtatgaaggatacagctgcgaaaaccaagcagcagataaggattacagcaatgcaaaaatactggggattgattatgcgatgcaggggatggcagtgttttcagaagagatcgagcttgaaaaagcagggttcttcaggaaaaatgaaaaaaggctggcaagggaacagcgtaaactgtcaagatgtgtaaaagggagccacaattatgtgcggcagaaaaagaaagctgccagatgtcatgaaaaaatacgcagccagagaagagattatctgcataaactgagccgcaggatcgcagaccaatacgatatagttgcggtagaagatattgatatgaaagcgatgagccagtgtctgcattttgggaaaagtgtacaggataatggatacgggatgttccggaatatgctggaatataagcttgaatggaagggaaaagaattaataaaggtagaccgctttttcccttcaagcaaaaaatgcagtaaatgcggaaagataaaaaaagagctgaaattatccgaaagagtttatcactgtacgtgtgggaatgagatggatagagatcgaaatgcagcaatcaacatccgcgaagaggcaagaaggatgctggcagcataaactgtccgtatccggataataagaaagaaaatatgcccgtgtccgggcaaaaaaatcgcggggcacgcgaggatagcttgtagatacttggctcagtagagccattgagcaagaagcccccacttcaaaatcagagatttaagtggtgggagcatgtcacaagaaagagcagaagaagagcagaaaaagttcagaaggaagaggcggagcgttatgtcagcatgtacagcagtcattgaggaactccatcaggcaatcgtggagcaaaggaatatggaggagctagaggggcttctctgggcgggggtgctcgcataccagaatcaaacattttacacgctttccggtctggaattctcctacacggtaaaacataagaaaaacggagactacagtggagaactgttgatctcacgtaaggagacaagcaagaccctgaccagaagctccgtgatgctggcattccacaaagtcctcgccgagatgaaattcaaagaaatcaatggagcagcatatcttcttcctccggaataccgcggaccaaaatcaatcgggcagatctttggaatctcatatatcttcagcatgtttcaggagtttggcctgattcgtacaaatgagaaaaagaaataaaggaaagagaaaataattgttgaaattatgcttgacaactaatttttttggatatatactttgataatcaaaatattctaaacccaaaacaaatcaggaatatgaggaaacaattattatgaataaagaacagaccttaaccggtgtcatccgcggaacgggagcctgtgttccaaagcgagtcatggataatgacgagattgctggttttgttgagaccagtgatgagtggatccgggagcggacaggtgtggaacggcgtcatatagcagaagaggaaacaactgtttccatggctgttgaggccggtcgccaggcagtcgaagaggccggaatctcaccggaagaaatcgatatgatcctggtggctaccggctcagctgaccgggtttttccatgtacagcctgccaggtacaggaggctcttggagctttgggtgccgttggatttgatctcaatgctgcatgcagtggatttcttttcgcttacaatacagcgcaggcgtacatagcatctggaatctaccgtacgattctgatcattggaagcgagagtctttcacgtattgttgactggactgaccgtggaacctgcatcttgtttggagatggagccggagcggttcttcttcaggcgaaggaaggaaaaagctatcagccggtttcacattccgatggacgaggcggaccggcactgaccggaccgggagtgcttggaagagcacgcagtattgatcaggatccaaaagaaacaaaaacagaatacattaccatgaatggcaaggatgttttccagtttgcagtccgcaaggttccgcaggtgatacaggaagtccttgagcgaaacgagcttttccttgaggatatcgactggtttgttcttcatcaggcaaacgcgcgaatcgtagatgcggttgcaaggcgacttcgtctggatattggaaaatttccaatgaatcttcaggattatggaaatacgtcatccgcgagtatcccgattttgctgaatgaactgaatcgaaaaggtgtcctgaaaaaaggacagaaactggttctggcaggatttggagcaggattgtcctggggcgcaagcgtgctggagtgggacatcacggagtgatgaagcaattcgtagatatccgatatctcaatattaaatagatacagaagaatagagaccatataacattggaaaaaaggggaacagaatttcatcataaaagtgaaatctgaaacccaaattatataaatttaattaaaacagaaaaaggagaaaacaaaaatgttagaaagaattatcgaacttacagcagaaaacttaggagcagacgcagcaacaatcacagcagagacatcttttaaagatgatcttcatgcagattccctggatctctttgagcttgcaatggcattcgaggaagaattttctgtagaaatcccaagcgaggatcttgagcagatcacaacagttgcagatgtaatgaactatctgacagagcatcaggcgtaatcgtcaacctggctgatcgagaggacataaatttatgaagacagagatcacagaattattaggaattgagtatccggtgatccagggcggtatggcctgggttgcagactatcatctggcagcagccgtatccaatgcgggtggccttgggctgatcgccgcaggcggtgcaccggcagagtgggtaagagaacagatccgcgagacaaaaaagctgactgacaaaccatttggtgtgaacatcatgttgatgaatccggaagcagacaagattgcaaaggtaatcctggaagaggacatcaaagtagtgacaacaggtgcaggaagtccggaaaaatacatggcagactggaaggcagccggagttaaggttattcctgtcattgcatcagtagcacttgcaaaacgtatggagcgctgcggcgcagatgcagtcgttgctgaaggtacagaggccggaggacatatcggggaacttactacaatggtactggtcccgcaggttgttgatgcagtgaatatcccggtgatcgcagcgggtggtattgcagacggcagaggtatggcagcagcatttatgctgggtgccagaggaatccagatgggaacaatttttgcagcatccaaggaatctgtgatccatgaaaattacaagaacagtattcttaaagcaaaagatatcgacagccgtgtaacaggcagaagtaccggtcatccgatccgtgttcttcgtaatgatatggtgcgcaaatatctggaactggaaaaagagggcgcaccgtttgaggaactggaaaagatgactcttggcagtctcagaagagcagttcaggagggtgacgctaagaatggcagtctgatggcaggacagatcgcaggcatgatcaaagaagaacgttcctgtgaggatattattaaatctactgtatccgatgcatgcagactgatgaatggagtaagtgtaaatgagtaagattgcttttatttatccgggacagggcgcgcaggcagttggaatgggaaaagacttttatgagaaaagtcctttatccaggacaatatttgaccaggcatctgaggcagtgaatctcgaccttaagaagctttgctttgaagaaaatgatcttctggacaaaacagaatatacacaggttgcaatggtgactgcctgtctggcaatgacaagagcggttgaatccatgggacttcatgcagatatgacagcaggtttaagccttggcgaatattgcgcgatcgctgttgcaggcggtatgtgtgatctggatgcaatccgtacggtacgctccagaggaatctttatggagcatgcagcaccggaaggaagcggtgcaatgtctgcagtacttggaatggatgcagaggtgatcgaggatgttttaaatggcagagagggcgtttctattgcgaactataactgcccgggacagatcgttatcactggtgaggcagctgcggttgctgaggcaggaactgctttaaaagaagcaggagcaagaagagtacttccacttaaggtgagcggaccattccattcaccgatgatgaggcctgcaggagaagagctggcaaaggtttttgccggagtcagcatgaatcctctgaagatcccatatgtggcgaacattaatgcagaagtgatcacagactgtggaagaatcgaagggcttctggtggaacaggtcagtggatctgtccgttggcagcagagtgtggaaaccatgatccgtgaaggtgtggacaccttcgttgaaatcggacctggcaaaaccctgacaggtttccttcgtaagattgataaaaacgtaaaagcttatcacattggcagctgggaagaagcagttcaggtgtgtgaggaattgaaataaaatttgataagaccggataaaggtacatctggtcacagcagatgccgagaggagagaaataagtggcagagcagagtaagaagaaagttgctgttgtaacaggtgcttccagaggaatcggaagagccattgccctggagcttgcttccagaggtgcagcagttgtaatcaattataacggttctgaggaacgggcacgagaagtgcagaaagagattgaggaaaaaggcggcgaggctgagatcagacagtggaatgttgcggattataaagcctgtgaaagtgccgtaaaggacattgtaaaaactcatggaagcattgatattctggtaaacaatgccggaatcacaaaagacggacttctgatgggaatgtcagaagaagactttgatcaggtgatcgatgtcaacctcaaaggaactttcaatatgatgcgctttgtttccagacagatgctccgtcagcgcagtggacgcatcatcagcatggcatctgtagttggaattgcaggaaatgcaggacaggcaaactatgcagcgtccaaagcaggaatcattggtatgaccaaaagtgcagcaagggaacttgcatcccgcggtgttacggtcaatgcagttgcaccgggatttattgagacagagatgacagcagtattatctgaagaagtaaaaaaagcatctgctgcgcagattccgctgggacatttcggcagaccggaagacattgcaaaagcagtagcttttctggcatctgacgatgcagcatacattaccggacaggtaattcaggttgatggaggaatggtcatatgagtaagagaagagtagttgtaaccggacttggcgccgttactcctattggaaataatgttgaggatttctgggcaggaatccgcgaaggaaaagtcggcatcggaccgatcacaaaatttgatacaacagattacaaggtaaagatcgcagcagaagttaaggattttaatgcaaaagatcatatggatccgagagccgcaagacgtatggatccattctgccagtatgcagtgacagcagcaaaagaagcttttgaggatgctggccttgatatggaaaaagaggattctttccgtgtgggtgttattgttggttctggtatcggaagtcttccgcaggtagaaaacaactatgaaaagatcctcaccaagggacctggaaaagtaaatccactgatggtcccgatgatgatctctaacatggctgcaggaaatatttctattcagctgggactccgcggcaaatgtacagatgttgtgacagcctgtgcatccggaacacacagcattggtgatgcattccgtgcaattcagtatggggatgcggaaatcatgctggcaggtggaaccgagagttgtatctgtccgacaggagtggctggctttaccgcacttactgcactgaccaagaccgaagatgtcgcaagagcatctattccatttgacaaagacagaagtggttttgtacttggagaaggtgccggaatcgtagttcttgaagaactggagcatgcgaaggcaagaggagcaagaatctatgccgagctggttggctacggtgcaacagcagatgctttccacatcacttctcctgcagaggacggagcaggcgcagccagagcaatggaacttgcaatggaagaagctggtgttcagccatctgaggtagaatacattaacgcgcatggaacgagtacgcatcacaatgacctgtttgagacaagagcgatccacaaagcatttggagatgcggcaaaaaatctggttgtaaattctacaaaatccatgatcggacatcttcttggtgcagccggtggagtggaatttgtgacctgcgttaaatctctggaagagggatttatccaccagacagttggaaccacagatccggacgaagagtgtgatctgaactatgcgatcggtgctccggtagaaaaagagatccattatgcaatgagcaattctcttggctttggcggacacaatgcgacacttcttgtaaagaaatatgagggttgataattatggaatttgaaaatcttcttacattaataaaaacagtatcagattctgaactgacagattttgattacgaagaaaatggtacccgcatccgactgaagaagaaaaaagaaaccgttgtggtttctggcacttcttcaaatgtaccggttatgggactccaaacagtgcagccgttgggacagatcacagaatcagaagcaaagatggagaaagatattgcagatggtgaaccagagggtatgcttataaaatctcctcttgtgggaactttttatgcagcacctgccgaggacgcagatccgtttgtttctgttggagatcaagtcaaaaaaggtcagacgcttgccatcgtggaagcaatgaaactgatgaacgagattgaaagtgattttgacggtaaagttgcggaaatttatgtggaaaacggacaggcagtagagtatggacagccgttgttccggattgcataaattcagggtataaacctgaaaaaatgtggatcattcgaatgtacagagaaattaatgtggataaacgaagtttccattgtaggagtatagattatgaataaattaggggtaaaagaaattgaacagattcttcctcacagacatccatttcttcttgtggattatatcgaggattatgagccgggcaaatttgccgtcggttataaatgcgtgactttccgtgaggacttttttaaaggacatttcccacaggaaccggtaatgccgggtgtcctgatggtggaagctcttgcgcagacaggcgctgtggcaatcttaagcctggaagaaaacaaaggcaagattgcatactttggcgggatcaagaactgcagattccgtggaaaagttgttccgggggataaacttcgtctggaaacaacgatcatcaaatgcaaaggaccggttggtgtcggtcatgcagttgcaagtgttgacggcaaagtggtagttgatgcagaactgacttttatgattggataggtgacacactatgattaaaaaagtgctgattgcgaatcgaggggagattgcagtacggatcatccgcgcatgcagagaaatgggaatagagacggttgctgtttattcagaggcagacagagatgcacttcatactcagcttgcggatgaggcagtctgcatcggaccggcaccgtcatccgagagctatctcagcatggaaaatatcatcagtgcaacgatcgttacaggtgcggatgcaattcatccgggatttggttttctttccgaaaacagtcgttttgcggaactctgtgaacagtgcaatattacatttatcgggccgccgtcaactgtgatcgcaagtcttggaaacaagcaggcggcaaaaaatacaatggcaaatgcaggggttccgatcattcctggtggcaaaaatccaatctatacagtagaagagggaatgaaggaagccgaaacgatcggttatccggtcatcatcaaagctgctcttggtggaggcggcaagggaatgcgagttgctgatacaccggcagattttgaagaaagtttccgtaccgcacagaaagaaacgcagatggcttttggcgattctacgatgtacgtggagcattttgtacgtcatccaagacatattgaatttcagatcatggcagataaattcggtaatgtaattcacctgggggaacgtgattgttccattcagagaaatcatcagaagatgatcgaggaatccccatgtgaggtgatctccgatgaacttcgtgccagaatgggagaggcagcggtgaaagcggcaaaagcagccgggtatgaaaatgccggaacgattgaattccttcttgataaagaaggcagattttattttatggaaatgaatacccgaattcaggtggagcatccggttacggagtgggtgacaggtgtggatcttgtcaaagagcagatccgcattgcatccgggcttccactatcctgtaagcaggaagatattcagctgacagggcatgcgattgaatgccggatcaacgcagaaaatccatccaaaggttttcgtccgtcaccaggaacgatcacggacatgtattttccaggaggaaaaggaatccgtattgattccgctgtgtacagtggatatacgatcccaccgtattatgattccatgatcgcgaaggtgatcgtgtgggcgaagaaccgtaccgaagcaatccgtaagatgcagagtgcgcttggtgaagtgatcatagagggaatcgataccaatgtagactatcagtatgaaatcctggatcatccggattttcagtcaggaaatacagatgtagaattcatcgaaagaatggaagcagataaataaagtgttactgtaaacggagtgaacagtaacgtatagttttggtattaacaggagtgaacgatcatgaagttggataacatgttcaaaaagacaagaattgtttccagaatacagagccatagtgcggtccgtgcttccaggccggaggtaccggaaggacttcttcgtaaatgtaacaagtgcggagctgccatcatcgcagaggatgtaaaacagggatattatatctgtccgaaatgcggaggatatttccgtgtacatgcatatcgcagaatccagatggtgatcgatgagggaacttttgaggaatggaatcaggatctgatcggtggaaatcctgtaaattacaaagggtatccggaaaaagtacaggcacttcaggagaagaccgggctcaaagaggctgttgtcacaggcaaaggcaaaataaatggcagagatactgtgatcgcagtctgcgatggaagattcctgatggcaagcatgggctgggcagttggcgaaaaaatcaccagagcagtagaacgtgcaacggaggaaaaacttcccattatcatttttgcctgttctggtggtgccagaatgcaggaaggaatcacatctctgatgcagatggcaaaaacttccgcggcgctggaacgtcacagcaaggccggactgctttatgtaagtgttttgacagaacctacgacaggcggcgtgacggcaagttttgcgatgctgggggatatcattctggcggaaccaggtgcactgatcggtttcgcaggcccgcgtgtcattgagcagactcttcgtcagaaactgccgaaaggatttcagagagcagaatttctggttgagcatggttttgtagatgatattgtaaggcgtgagaatctgaaggaaacacttggtaagatcttggagatacatgcggtatcctggaaaacagaaaacaggatcagaacggatgcagctgaattacatcacgcggatcatccgggatcagattctgaaaatctgacaaatgacaagtgtgattcggatagaggagattctaatccagctggcatcaacccttacctcacagcctgggatcgtgtacagatctcacgcaagattgatcgtccatccggcagtgattatatagaagcactttttacggattttatggaatttcatggagaccgaaattacggagatgataaggcaatcatcggtggaatcgcaaaatttcatggaaaaccggtcactgttatcgtgcaggaaaaaggaaccaacaccaaagaaaacattgcacacaatttcggcatgccgatgccggaaggatatcgcaaggcgctgcgcctgatgaagcaggcagaaaagtttcagcgtccggtaatctgttttgtggatacgccgggagctttctgtggtatcgaggcagaggaacgaggacagggcgaggctattgcccgtaatctctgggagcttgccggactgaaaacaccggttctgtctattgtgacaggagaaggtggaagcggtggggcacttgccctggcagcaggtgatcaggtatggatgttggagaattccatatattctattctttcaccggaaggatttgcaagtattctctggaaggacagtactaaggcaaaagaagctgccgcggtcatgaaactgacagcatcggatctgtatgagaaaggaatcattgagcaggtgattcctgaaccggagaatctgacaccggaaagtatgtggcaggtggctgaacgcctgaacgataaaatctgtactttccttcaaaaatatacatctctttccgaggaagaactcctcgaaacaagatacgcccgttttcgtaagttctgaattgaaatatcacgcgactcacttctttcacttttcctacattatatagaaaaaggcgcgcaggaaaagaaaaatatctgggacagaaaaggaaaagtgtggaaaaaccgaacacttttctttttttgtctatacaaaaggacagaaactggaattataatatataaaaagaagaaaaatcggaggagacacgaatgaaagaagtaaaatcgccaaagaagccgttactttattattatggaatcgtgcttctgatcataattgtttttaatgtgcttgtaaccccgatgctcacaaaaacaatggtcaaagaagtcgattatggaacttttatgtcgaagatcgaagataaaaagattgatgatgtccagattgaggataatcagatcctttttacagataaagatgataaaaataccatctataaaacaggcgtgatggaagacccgactttgacagaacgtctttataaagcgggagcaaaattttccaaagaaatcgaccagcagatgtcacctgtagcaagttttctgctgacaggagttcttccgcttgtgctctttattgcgcttggtcagtatatgagccgcaagatgatgaatcagatgggcggtaagaattccatggcatttggaatgggaaaaagcaatgccaaagtttatgtaccgtcaaccgaaggtatccgcttcagtgatgtagccggtgaagaagaagcaaaagaaaatctgcaggaaatcgttgattatctgcataatccggagaaatacaccagggttggagcttccatgccgaaaggcgttctgcttgtcggccctccaggtaccggtaaaaccatgctggcaaaagcagtagccggtgaatccaatgtaccgttcttctcgatgtccggttctgaatttgtggaaatgtttgttggtatgggcgcatccaaagttcgtgacctctttaaacaggcaaaggaaaaagcaccttgtatcgtattcattgatgagatcgatgccattggtaagaaacgtgacggacagatggcaggtggaaacgatgaacgtgagcagaccctgaaccagctgcttacggagatggatggttttgagggaaataacggtgttattattctggcagcaaccaaccgtccggaatctcttgacccggcactgacccgtccgggccgttttgaccgccgtgtacctgtagaacttccggatcttgaaggtcgtgaagcaatccttaaagtacatgcaaaaaaagttcagctttctgacgatgtggatttccatacgatcgcaagaatggcctcaggagcttccggtgcagagcttgccaatattgtaaatgaggcggctcttcgtgctgttcgtgataatcgtgaagtagtcacagaagcagatctggaagaaagcattgaagttgttattgcaggatatcagaagaaaaatgcggtactttcagatcaggagaaaaaggtagttgcatgtcatgagattggacacgctcttgtagcagcaatgcagacacattctgcaccggttcagaagattacgatcattccaagaacttccggcgcgcttggttataccatgcaggtagagcagggagacaaatatcttctgacaaagcaggaactggagaataagattgcaacatttaccggtggccgtgctgcggaggaagtggtatttggtgagataacgaccggtgcatccaatgacattgaacaggcaaccaagattgcccgggccatgatcacccgctatggtatgagtgatgactttgatatggtggctatggaaaccgtgacaaatcagtatcttggcggtgacgcatccctggcatgctctgcggatacgcagaatgagattgaccgtaaggttgtggaactggttaagagagagcatgagaaagcgaaaaaaattcttcttgataaccgtcagaaactggatgagttatccaattatctctatgaaaaagagacgatcacaggagatgaatttatggcaatcctgaatggcgaggcaaaaaaagagacaaatacagaaacgaaaatagaatcaggagctgagaagaaggaggcggatgcagatgaacagacgatctgatattggatggtttgaattaatcgtgggtatcattctgatcatatttggtgttgtgatcatgcgtcagccggtaggggtacttacctggatcgtgattctgtgtggtgtgcttgcaatcttaagcggaattggggatattgttctgtatgtcaaaatggaacactttaccgggtttggaccgatcgtttcacttgtcacaggaatcctgagtgtgatggccggatttatgctcgcggcacatccggaagcaggaaactgggcgcttgcaatgattcttccaatctggattattgcgcattgtatttccagactttctcatctgcagtatatgaagatgcattacggaatgacttattatacgatttcactgattctgaatatccttggtctgctcgttggaatccttctgatcttccggccgatgatcacgatcctttccatgggtgtgcttgtaggaggcttcatgatcattgagggagtggagctcattcttgttggactggacggcagacaatattacagataaaaaagaaattcaggtacaggtggatctggtattggcctgtcagttgcaaaagcaatcgtacaggcgcataaaggtaaaattaccgcagaaaataaaaacggaaaaggattgacgatcacgattcttctataaaaagaagaatatatgaacaaagccgccgcactcttgtgcggtggctttttatattgtaaaatatataaaataaaacttcttagggttcaatgacaaagggaggagaagttttgaaaaataattataccgtaagcagcagaaaaagatttctgttctatattctgatgatattaagtctgctctgtatcatagcattgcagttttttggacagaatgaaagggatggaaatacaacagaaaaaatcttatttaccagggaacttttacctggcagaaatcagatggaagcagtgaaaagatcagcgttccgggacagtatgatgtaaaagcaaaggatacgatgactatcctgaccagactgccggaagattatcatgagaatacactggcaatccgttcatcacttcagtcggtccgattttatgtggatggagaactgagaatggaatatgatacatcagggactagacttgtcggaaaaaactcagcaagctgttatgtgttctgtccgacatcagaagatgatgcaggaaaagaagtgcgtattgaacttaccacaaatacagcaaaatattctggagtggtaaatactgtttattgtggagatgaggcagcaatctgggggtatctgtttcagacgtatggactggagactgtcattgctctttttttgttgtttgccggaatcattacgatcatttttgggttttctctcgggattgcctatcagacgaaatttgatatggaatatctgggctggtgcgtttttatggcagcaatctggatgcttggtgagtccaagatgcggcagctgttttttccgaatccgtcagcacttgcaacgctgtgttttgtaatgatcatgttaagtccgatcgcaatcggatattatatggatacgctgcagaaaggaagataccggaaagtatttggagtggtagaaagcatagcatttctgaatgctctgatctgttcagcacttcatattcttgggattgcggattatatcgagacacttcctgttgcccatgtgatccttgcaggcagcgttctgattgggttcattacgatggtctgtgacctgaaaagaggatatgtgtcagaaaaatatacttttttcagtattatattggcaatgatcgctattatagcagagtcgagcctggtttatttcagagtttccgcatcaggaatctttataggaatcggaatgatcatactgctgtgcacaaacctgctgaaaacgatcaaaaatatccagaaagtggaaagccgccgtcagagagcagagttaaataagcgcaggaaacagatggaaaccatgtcactgcagatgatgcggacactttccacaacgattgaggcgaaagatgagtatacaagaggacattcttatcgggtggcagaatacgcagctctgattgcagaagaacttgggtgggataaaaaagaaatcagaaatcttaaaaatgcagcacatctgcatgatatcggtaagatcggtattccggataacattctgaacaggccaaccagactgacggaagaagagtttcaggtaattaaagagcataccgtcattggagcagagatactaaaaaatattacgttgatcgatcatgtgaaagaggtggctcgaagccatcatgaaagatacgatggtatggggtatccggatggattgaagggcgaagaaattccgctgtatgcaagagttatagccatagcagactgttatgatgctatgaagtcaaggcggatttacagaaatccgcttggagatgaagttatatataatgaaatatccagaaactgtggatcacagtttgaccccaagatcgcaggagtctttctgaaaatgttgaatgaaggtcgcgtagtgatcagagaagacggcaagcttgcagataaagaagataatcttctgaatatggaagcagaaattgaaaagttcatctccactgtaatgataacaatgaaaacacaggaagacagtgaaggatttgattttctgacaggattgccaatgagaaatcgtggtgaaaagcttgcggcacagtttatgcagcaggacagcggttatctggtatttcttgacatggataacctcaagaagatgaatgacctttatggacacaaagcaggagacagagcattgaaattacttggatctttcttgatggaatatgcacatcattccgttgtctgccgcctgggtggggatgaattcctgatgtttgtgccgaacgtttcaaaagaaaagataacagagatcgtcacagaaatccaggaaaaatttgaacagagcaaggaaaaggatgtagcgatccgttgtgcttctgtttctgccggaatctgtgaagtaaataaaggagatccttttgaagaatgctattcaaaggcagataaggccctgtattatgtgaaacagaatggaaaaggaagctttttcttctatcaacagatggaaggggaaaagattgttggctatggaacaggaaaagatctgacactggtttccaaagcactgagcgccagcggcgattattccggggcacttgagctggattatcgtgaattcgccaagatatatgaatatatgaatagtatggaaaaaagatacaaatgtcattgttatctggtgatggtaacgctggaaacggaagcggattctgtattaaatatcgaagacatagaatatgcactggaatgtatggagcaggcaatacgacaaaaaatacgaaaggttgatgtgtgcacgcgttacagttccatgcagtatctgatcattctgtttgaaccagatgaaaaaacaattccaaatatcatggaacgtattttcagtcaatatcgtgagcagtgcggaaagaaaaaactgcttcttaattatgaatatatgtcaatgacggaaaaataatacagaggctgaattgttggaacattacggagtaatttcctataaagtaaagtaaaaagcgcggtcgtaataaatgcgactgcgctttttgaggttaaagaatgattttaattaatggcatattctgattaaagaacatcttctctgcggatatatccaggatgtccttcttctgcgatgatctcattgccgtggatgaccttggcccatttatccattacctgattttcaagatgagcattctcgccgacaacagtatgagacaatacaatgctgtttttaatgacagcaccggctttgatctggcatccacgtccgataacggaattttcgactgttccttcgatcagacagccattggagataacagaattcttgacagatgcaccttccagatactgggtcgggcaggaatcgttggttttggtataaattggccattccggattgaacagtccttctgcagttttgatgtcgatcagagagatatttgcgttgtaataactgttaaagtcagtaatggatgcaaaatatcctctgtgtgaaacaccgcggatatcgagatccgcagaagattcattgacaatctgaggcagagtgtacatcgaagaaattttccgggcttttttgatcagttcaatgaaaagctctttactcataacatatgtatccatgaagatgttgcgtttctgggcacttccacggtttttttcgatggattcaacacctttctgtttgttcagattcagaatatcacagttcaggaatttttctcttgcattgtccacagaatgatacaggagtgtgatatcagcaccggaatcaatatgtgtctgaagaagttccctgtaatcttctgcatataccatgtaagatggcgcgatgatcacatatggctcatgcattctttcaatgaattcaatattttcataaaatgatgcgatatctgtattgtatacatcattttcggaactgttctgagcgaacataagctgcagcttgccacgtttggagttgatgttgtaatgacgtccggttccgagatgttctgccagagaacgtggcttggttcttacatatacctggatgcggtcgataccgctgttgctcatatttgaaataggaaagtcaatgacacgatatcttccaaggaaggaaaaagcaccgattggacgatactgctgaagtccttctactttgatatgggttccggaagatgtgacaattccaaatgctcttgccatattattctaccccctttacacgtttggacacgagttcgatattttcactgtctgcactgcctacaacagcatcctggccaatcttgacattatcagcaacaagtgcacgctgaacaactgcgccggcggcaacttctacgcctggcatcagtacactgtcaatgatcttggcaccctcgccgactttgcatccggtgaacagtacagaatgcttaacttcaccttcgacaacacagccctgtgtgataaatgctttgtcgattttggcatttggtcctatgtactgaggaagagcaggtgtgtcttctgtgtagatcttccatgttggatcgttcagattcagctcatttctggaatcaatgaggtccatatttgcttcccagagagagtcgatggttccgacatctttccagtaacctttgaatttatatgcggcaagtgttttattgtcgttaaggagacacgggataacatccttaccaaagtcatggtgggaatcaggattcttcatatctgcaagaaggatcttgcggagaagcttccagttgaaaatataaatacccatagaagcaaggttgctcttcggatgctctggtttttcttcgaattcaacgatgcggccgttgccatctgtgttcatgataccgaaacggcttgcttctttcatcggtacttcaatgactgcgatcgttgcatcggcattcatttccttatggtaatccagcattttgtcgtaattcattttataaatatggtcgccggaaagaactaaaagatattccggagaatatttatcgataaaatcgatattctgagaaatcgcgtcagcagtacctctgtaaacgtcaagatctgcatcagctttttcacgtggtggaagaacaaagactccactttctctggcatcaagtccccagcgtccgccagctgctacataactattcagaagaacggattcgtactgagtcagtactccgacaatgtccactccgctgttagcgcagttgctgagcgggaaatcaacaatgcggtattttccgccatatgaaactgccggcttggctactttgttggtgagttcatgaagacggcttccacgtccgccagccaggatcatcgctaacatgttgttttgtttcatagtgaaccctcactttccttttagattgcttatatgaatctattatacattttttacaaaaacatttctacatttttgagcaaaaaagtgtggcttgattgatatttttttttgatgattgttaagtgtgtattaaattgatggaaaaatttcgacaaaaacataaaaaagtaacaaaaacagaggagcggacgagaaatgctgtatacaaggctggaaaggagccgacaatcactggacgaaaagtatgttttacgttataataacaaggttaaagggaaaaataaaagtgctatttgacggatgagagggatatagtgaacagacgagaggattttaaacgttttatagtattttgtctggcaagtcttgttgtgatcgcacagacagctgtttttgcatatatctggtatgactattacagaggacttatttttgaaccgttctggagaaaaggtaactgggtcctgattgcaatctacggattgatcaatgttttgttttccagactttatggaggtctgaaagtaggatatctgaaacgcatagatgtattttattctctgacgctggctacgatctgtacaaatatcgtgacatattttcagatcacgttgatcaaccgatggttcctgagaccatggccaatgatagagatgacactgattcagtttgtgatcatccttgtatggatatggggttccagatatatttattcaaaattatatcaggcaaggaaacttctggtgatttatggagaccgtgatcctggtgatctgatcagtaaaatgaattccagacgtgataaatatgatatcagcggaaaagttcatatcagtgtgggtgagaaagaaatttaccggatgatgaaggaatatgacggagtgatcatatgggatcttccggcaaatatccgtaaccgttatctgaaacattgttttgcacattctatccggtgctatctcagtccgaagatttctgatgtgatcctgatgggaagcgaacgcattcatttgtttgacacaccgcttcttgttgcgaagaacatgggactttctattgagcagcgtgcagcaaaacggctgttggatattattgtttcgggtattggaatcatagttgcatctccactgatgctgatcattgcattgtgtgtgaagttttatgacagaggtccggtcttatatcgacaggaaagacttacggagggcggaagaccatttaagatctgtaagttccgtagtatgtgcgtggattccgagaagaacggtgcaagacttgcatccaaacatgacagcaggatcaccccggtaggaagagtactccgcaatctgcatctggatgaactgcctcagttatttaatgtatttatgggggatatgtctctggttggaccgagaccggaaagacagacgcttgtccgcgaatactgcaaggaaattccagagttttattatcgcctgaaggttaaggcaggacttaccggttatgcgcaggtatatggtaaatacaacaccacaccttatgataaactgaagctggacctgttctatattgagaattactcttttgtacttgacctgaaactgcttatgatgacagtgaagatattcttccagaaagaagtttctgaaggagtaaatgataatcagacaaatgcactgaaggattcagtggatccggtaaaagaactttctgagaaagaaccggtggatccggaagaaaaagaataagccacgggggtttaccccgtgactttttttcagcttttttccataaaagctacatattcatcaaggacttcgtccggatcaccgattcgcttgatctgtccttcgtgcatccacataacagtatcgcaaagctgtttcagagtttcgatactatgggagacgataactacggtacgatctttgttggagatcaggctcttcatcttttcataactcttctttttgaatttctggtcgccgacactcaatacttcgtcgatcagcataatgtctgtttcaagaatagctgtgatggaaaaagccagtttggaatacataccgctggaataagttctgactggcatatcaatgaactcgccgatttcagcaaaatcaatgatttcctgttctttggctttgacctgttcttcagtaaaaccaagaagcataccggaaagagtgatattttcacggccggtcatctcacggatgaaaccgacaccgatggacaggagtgaaatactgtgtccgttcaggtcaatagaaccactgtccggagaaaagataccagccagtgcgttcagtgtggtggattttccacttccgttcttaccgatgataccaaggatctcgccttcgcgaacgtagaaggaaattccttttactgcaacaaaacggtcaggtttctgacgtttcagatgaagcagagttttcttaatagaagtttttttcagattctggtagctgataaccagatctttgacttcgattgcatgcttttcttccatattaaatcacctttacatagctgttttcgctcttatagattttgcggataccaagggcacagagtaccagcccgatcaggaaccacagaagcagaagcttacgatgaggtgcctgtccgtagattacgcactgacgcatggatgtgatcagaaatgcgatcgggtttcccttgccgatgtagttgttgtatggtgccggcagacgactcatgatgttccagaatacaccggtcaggtagaatacaaggcgaagtgcgatacgcagaacattgccaaggtcttctacaaatacaccataatgaagcagaaaacaactgataccaaaaactacagtaaccagtgtgatcagaattggaatcacatacaggatattcagagtcagcggaacgcgccatatagcaagcatagcaacgatgatcagcagagaaatgcacatcttgaagccgttgacacatattctgataaccagaaggatgaattttggtatatatactttggatacgattggtttgttgttcttgatgatcttgacactctgcaacagacacttgttaaaaaagtcccagagagtgatgccgacaaaaacgaagatcgcaaagtactgttctttagacttaaatacatatccgaacatgaatacatagatcaacatgaagcacagaggatccagtacccaccagagccagttcagataggaattggctacttcagctttcaactgggctttagaagagtaaatggcatacttccagtacttcttcatgtcatccctaaatcgtttaaacataaaatccgctcctatattttctttattaaattatagaacccccagtaatctgagggctgtgaccttacttatcatacactaccaaaggtttgttgacaagagaaatctattgttctttctttattattttgcaagaaagcttgtattttgcaggaaaaagcttgacttatatagtatggttgtgctaaactagacgagcgacatggaagttaggtcttttttttatgcccgaaaaaggcaaaaaggcccacgcaaatgaaaacactggaggtggaagttgtgcgcgttaagattacattggcatgtacggagtgcaagcagcgtaactacaatatgaccaaggagaaaaagaatcatcctgagcgtcttgaaacaaagaaatattgtaagttctgccgtacccatactctgcacaaggaaacaaaataatcacaaacgattgtgaggttagactatgcaagagaaagaaaaatctgctggcaaaggtcagaagagaaattggtttcagggacttcaatcggaattcaaaaagattgtctgggttgacaaggctacacttgtaaaacagactatagcagttacaattattacagttgtacttgctgtgatcatcagtgtatttgactcagctattctggaaggaataaatcttttagtgaaataaggataacggtgattgtatgtcagaagcgaaatggtatgttgttcatacttattcagggtatgaaaacaaagtaaaagccaacattgaaaaaacaatcgaaaacagacacctggaagaccagattctggaggttcgcgttccgctgcaggaagttgtggaaatgcgtaacggtgctgccaagcaggtccagaaaaagatgtttcctggttatgtgcttctcaacatggtcatgaatgatgatacctggtatgttgtccgcaacaccagaggtgttaccggattcgtaggaccgggatccaaaccggttccgcttacggaagaagaaatgctcccgttaggaatcaagaatgatgacattcaggtagactttgcagagggtgatatggttgttgtaacagctggagcatggaaagatactgcaggtgttattactgcaatcagcactcagaagcagacggttactatcaatgttgaattgtttggccgcgaaacgccggtagaaataagtttcgcagatattaagaaggcgtaacacattcaagtgggagggaagaacccccgccaataccacataggaggtgccgaaaaatggcaaaaaaagtaacaggttatattaaattacagattcctgctggtaaagcaactccagcaccaccggttggtccggctcttggacagcacggtgtaaacattgtacagttcacaaaagagtttaatgcaagaacagcagatcagggagatcttatcattcctgtagttatcactgtttatgcagacagaagtttcagcttcataaccaaaactccgccggcagctgttcttcttaagaaagcagctaacatcaaatcaggttccggcgtaccgaacaaaacaaaggttgcaaaagtaacaaaagctcagattcaggaaatcgctgaactgaaaatgaaagacctgaatgcagcatcccttgaagcagctatgagcatgatctctggtactgctagaagtatgggaatcgaagtcgtagactgagaaaaaattaattgaagtgagtgggagggaaattcccgcaattaccacaggaggttatagaaatgaaacgaggaaagaaatacgtggaagctgctaaagcagtagaccgcgcaacattatatgataccgctgaggctatcagccttgtaaagaaatccgcagttgctaaatttgacgaaactatcgaagttcacatccgtacaggctgcgatggacgtcatgcagatcagcagatccgtggtgcagtagttctgcctcatggaactggtaaaaaagttcgtgttcttgtattcgcaaaagacgctaaagctgaagaagctaaagcagctggagctgattacgtaggagcagaagatctcatcccgagaattcagaacgaaggatggctggatttcgacgttgttgttgctacaccagacatgatgggtgttgtaggacgtcttggtcgtgtacttggaccaaaaggtcttatgccaaacccgaaagctggaacagtaactatggacgttacaaaagcgatcaatgatatcaaagcaggtaagattgaataccgtcttgacaaaaccaatatcatccatgttccgatcggtaaagcttcctttactgaggaacagttaagcgacaacttccagacgctgattgaggcgatcgttaaagctagaccaagcacactgaaaggacagtacatgaagagtatcgttcttacacctactatgggacctggtgtgaaggttaacccggctaaattcgcctaaataaatgacaaaaggacatcctttaaaagggtgtcttttttatttccctaattttgccgggtactgcccggggtcccgctatttggcaaatgggaaaaaaatccgagggggaactcgctcacagttgcgaaggccgctgttccccctcggactcccccttgtcggccacgctgaaaaacaaaaaggctgagtttgctggggaagaaatggataatagagatataatatggtggatactttttaggaatggttgcgatgtggtggagcgacaatttatttcaagggttggtgagtgagtttgtggagtatgttggaggcggggtgggtgtatccgggagggggaagcctgaagaggttcgtgaaagtacttaggctctgggattttgtgttgagcataaaaatggcactgtttgagcgaagcgagtttgacatttttatgatcgcttttagcaaaatatcagagtcttagtactttagaaccgatgaattttcccactccggatacacccacccccgcccttgcatctccaatcatacccatcacagggttccctttttttcttaataaaacattaaagttttttacaggattttgtggtaatatgatacaataataagaaacttcaatagaaaagaaggggcggtatggctgataagaaacgtagaaatactccaaatacaggaaataaaagaaataacggtcgaagaaaaaagaagggcaggctcaagggtctgattgctgcagaactgatcgtagttgtcgttcttgtaatgatcgtggggcataatctgggactgggaacaggaatcaccaacttcgtaaacagtatccgtaaacctgcagtcgaggaactggatatcacagggatcaacagcccttatgcggtgctcatgaatgcaaagagtggtaaagtcatcggtgatatcaatggtgaagaacagatgtatccggcttctatgacaaagatcatgactacaatccttgcgattgaaaatctcaaggatttgaatcaggagattacgattacaaacgatatggtagcggatctttatgtgcaggatgcaatgcaggctggatttcagccgaatgagacagtgaaggcaattgatcttctctacggagtcatgcttccgtccggtgcagagtgctgcgtagcattggcagacaccgttgcgggttcggtgagtgattttgtaactcttatgaatgaaaaagcagagaagcttggaatgacaggtactcatttcagttccatttcaggactgcacagggaagatcattacagcacagcaaaagacattgcgctgttgcttcgttatgcgataaaaaatgacactttccgtgagatcattgaaagtccatatcattctacatcaggaacaaatattcatccggatggaatcacattttacagtacgatgtttaagaatttgtcggatacttctgtgatcgatggagagatcaaaggaggcaagaccggatacacgagtcaggcaggtcattgcctcgcaagttttgcagaaattgatggagtagaatacattcttgtaacagctggtgcaccgggcacgggtaatccgcatattgatgatgcagtaaaattgtataaccggctgggtgagtcatcctctgtattgtatggaagataatgtgcggcaggagatacgaagttttggacgaaattaagaaagtttctgaaacagttcaagtgcaagttctttgaattctttttctacagaactgaaagtgcgctcagacaggtcgggagtagaagacagggggatgatctccctgtctttttcacctttcataagagtttttaattccagttccaggatttcattatcaatctgtttccatttttgattctcttcatcagttaggtcatcaagatgaaatttttcccagatcgcatccatgatcatagattcgatttccaggtagttctgcagatggactttaaccgggcggatgacatcggaaatgtaacattcacttgcatcgtgcagaagacaggcaagagccattcggtcagaccatccacgtgccagagcttcatgagcacagttaatggaatgctggcctacagaataaaaccaccggatctgcccgccaccgcggcagacaagacttaaagcatgtgcaatatcttccagataaacatcttccggggcgatcttcatgggatcaaattttcgcccactgtatgtattcattacgctcataaatgacacttcctttttattgtttgagagactgtttcatatatatatatatatttagtatacgcactttttctataatatgaaagaacatttgggaaaatgtttggcattgcaacagactttcaaccattttattagtgacagacagaaaaaatccccctaaaacattgatatatccaaggtactgatagcatatcatgttttaaaggggattttgctctattatgtgataaatgaaaagatgtagtttcagaataaagtttcttcgttttcatcaaacagtttgtcgttgatctcaaaaagatcaagtttgtgcagaagtccgtaatatataattgcatcacgtttcagcttgggatataattgggcttttccgcaacgtctcaataattcctgggtttcttctacgcttgcattcagaccgtaacacagacacagcagacggtttcgggaaggattccggcgaccggcaaaaatctggtgcagatagatttcgctcatgcctgcctgtttggcgagagctgcttttgagatatttttcttttcaaacagatggtttaataattctgctacatttttatttacaaactgttcctggttttgtgacagaaactgagtcagatctggtgaatccataagttcctgctgtaaaccatctgtatttttctttttcataatccgcgcctttactcatcgttatttttgaacaatatattgctattcgtgctgctttacgaatagtattaatagtaatacaaatattctatttgttatattacttgctgaataattactaataagttataatattttaaatagtatacataaattaaaatatactataaacagttctgaaaaacaatatgcagaccgcatagtaaaaaggaatatcagttacaacagtaacgagtaaggatgagaaatatgaatatttacgacagtcttttgggtgcagttcatagcgaatatgatgtgctcatgctgatcaaaaaaagtgaacggggcgaggtctcacttgtacgtcacagagacagcggcacccgttatattttccggcatttttatggaaacagtgaagtttatcagaaacttctgaatgtttcctgtccaaatctgccgcaaataatggaagtcggagaaaaagatggaaagacagctctgctggaagaatatgtgcagggcgatacgcttagcgagatcctagaaggcggtcttctgacaattgcggagtcgaaacagattgcaagacagctttgttctgcattgtgggtatttcattctatgggtgtggtgcacagagatgtgaagccggataatgttattatacgtggaaaagaagctgttctgatcgattttgatgcatcaagaatatataaaagcacaattcaggaagatacgcagattctgggaacaactggatttgcagcaccggagcagtatggcctttcgcagtcggatggacgggcagatatctatgcgcttggtgttttacttaatattatgctgaccggcgaacatccttccaggaaacttgcaggtggcagaatgggaagaattgttcaacgctgtacaatggttaatccatcaaaaagatacaagaatattcttcatctgctggaggttctgtagcaaattttctataaaaatagagaagaaaacaaaaagagataaaggggaaagtcaatgagtaaaaagtgtataaaatgtggggagatactgccggatgacgcgtctttctgcccgcactgtacaacagttcagacagaaaagaaagagataaagacgccaagaaagtggagaaagaaagcagtgataggagtggcagttctggccgtagctgcggttatcggaatcgctttttctatctatcacagaccaaaaacatatgaaggcggtgctcagatcacttatacggataagggaaaatcatacaaagttctgctgagtttttctgaggaaggcggtatgactggacatgcccagggtgagcgcacagatacgctgtcggaaggcatgaacagtgcacttccatgtcatctgtatgtattaaacaaagatacaggagaactggctggagaagatttttccaaagaggtagagtcctgtaaagtagatacaaagccatcagagggatcgcagaaaatggaatatgtagaaccggtatacaatgaaagcttcccaaatgcagcgtatgtttctgatatcaattatgtatctgacagtggaacgaatgatatccagtggacacttaccatgaagaatggagatacaatttttctcagtacgagacttacgattgaaaaacagccggcagtcagctattatccggaagatacaccgatggagaccaccgaagagttgaatgccctgcttgcttccattgaagaagaggtaccctcagatactccggtatatctgcatcttccggcagtgacctatgacggagatatcacttttggcgatcatgtctggggcatttcaggaagcaaagacggtgatgcggtgactacttttaccggaactgtcagtataaagggacatgatggcaactatgcagatctgtcggggattaattttgaaggtgagggtggaatcggactggatgcgtattgtctggtgcttcttaccgattgcaacttcacgggttgggatacggctgctgttgcacagaatggtgcatgggttaatgcaatggaatgtacgttcgcgaataatacggttggtttgaaatttaatacctctatggcttacggtactgcgccaaactatgtgaataatacatttacggataatggaactgctgtctgcattgacagtctgccgggaaatgaggttattgattttgccggaagcgtgttctcgggaaatgatgcggatattgagaataaagcagatcatgcagtagatacagcgaaagcgacatttgaataaagaacagtctgaaagcttctgcgatataatttgcaggagcttttttgtaaataaaaacataaactatgctgcgaggtaatgggttttgtttctttttcattttataataatttatcagtctgtttgcagacaataaaaaagaagggaatggggtttatatgaaaagaaacaaaatcgcaatgcttctggcaatggcgcttactgttacacagagtgtagttgtaccggtagcagcggaagaactcacagcagatgttgagcaggaagtggaaatgagccaggatgatgctgatgcagaagcagcagtagaatcagaaggggctgcttcagaggatgcagaagtaaatattcaggaggatgagttttccgtaggagacggtgaggatgcagaaatccaggaagaagcggaagaaacgcagaatgtggattttacagccggagatgaaagcatagaggctgtaggggaagaagaatccaaatatagtctgatgtatgattttatggacgggcatacaggaaatggtactatgcttccaaacagccagatgacgatttcaaccagcgtgtatcattctgatgaagatggcgatgagacaatttcagaagcatacaaattagaacttaaaccaatggaagatgattgggactataccggaaaggtagatgtctctgtagatgataataatattgttataaattctcatggggtaacaggagcttttggtatttatgtgacagtcagctcagatgcttttaaaacatttaccagtaaagtttattttgaaatcagtgaatatgtgatcatgccggaaaatgccacggatgcagatggaaatgtacttaatcctaaggtgggagaacagattgatattgccaaagatatgcaaccacagcttttccgttatgaaaaagatacgaagaagcttagtcctgtaacaggagataattataagattattatttatagagggacagatgaggaaacaggtgaacctgataatgactacgatacagaaggatgggaatggattgaagtttccgggcaggaacttccgatattggagagaataacggaaaacggtaccagctttgctctgacagctctggagaaagatgaagacggaagatggaattatatcgcaagacgtgattatcaggtagattctttacatgatgatggagatgacggggatgatggagatagcggagaccatggtaataacacaccgatgctgggaccggatgttcttacagatgcaaatggaaataaactgaatccgcaggttggagaagtaattgattatgcgaagaagggcgttgctctgtatcattatgtaaatggaaatttaacaggtgttggagatccagagacattaaaaattgaaacggtgtatgatgaaaatgactggagcgtacagtatacggaaggctgggatgttccgaccatgacccgaaagacaaaagatgctacatggatcttttttaaggcatgggagaaaaaactggagacaggaagatgggaaataattgatacaaagagatatgaatttgatgccacagataaagtacacagccacagctgggtgactaaaaatgttgtaaaagaagctacctgtacagaagcaggaagtaaggttgaaaattgtgcttcctgtgatgcagtgcagactgtgtcaatccctgtaaaaggccatactgtaatgaaagatgcagcagtagctccgactgtatttgcagacggaaagaccgaaggaagtcattgttctgtatgtggtacagtccttgagaagcagaatacaatagcaaaagttccaggtaccatttatctgacagcttcttcattgaaaatgaaaacaggtcagtccacaactgcattcaaagcaacgggattttcagaaggagactatgttacagcagttacttcaaataaaccgagaactgtaaaagtaacaaatgtaaacaaaaatggaacattcaagctgactgccggcaagaagaagggaagtgctgtagtcactgttactcttgcaagcaaaaagacagcaagcttcaaggtaactgttcagaaggcagcagtaaaaaccactaagattacaacaacaacgaaatcactgacacttgcaaaaggagctacctacaagaaattggcttcttctattgcagttacaccagtaacaagtaaagaaaaagttacctattcatcttccaataagaaggtagctaccgtcagctccaaaggtgtgatcaaagcgaaaaaagccggcacagcaaagatcactgtcaaatcaggaagtaagaaagttgttgtaactgtaaaggttaccggcgtaaagacaacaaaactttccggtgttccggcaaccaagaagatcgcaaaaggaaaatcctttaagatcaaagcagcagcaacaccaaagaacacagatgaaaaaattacttttaaatcatctaacaaaaaagttgcaactgtaacatctaagggtgtagtcaaaggtctgaaaaagggaacagcaacgatcacagttcagagtggttctaagaaaatgacatgcaaagtgactgtgaaataataaaatgaaggttactgttcgcagcaacaaataaagtgtaagaggcgatctccgtgagcaattgcggagatcgtttttgtttgaaattcgagatttctgccaggtaccaaaggcttttgcctgagtatgaaaaagattatttatagacgacactgattaaaaagtgttataataaaacaacttaaaatacaaaaaggggactgagcagatagatggaacctgagaaactgatagaaacattagctgtggcggagcgtctgaaagatgccaccaggcactgttatacatccagaggccgcagggaaagcgtggcggagcattcctggagaattacgttgatggcatatcttgtcagtgatgagtttccggaagcaaatctggaaaaattaatgaaaatgtgcttgatccatgaccttggagaggcatttactggggacataccaacctttgaaaagtcagaaaaagatgaagaaaaagaagcatcacttttaaacgaatggatgatgcagctgccggaaccttttgtcagtgaaatgcaggagctttacagagaaatggaagagcggaagacgctggaagccagaatctataaggcactggataatctggaagctctgatccagcataatgagtcggatatcagtacatggattccgctggaatatgatctgcagatgacttacggaaatgataaagtgcagttttcggagtatctgacacgtctccgtgatgaagtgcggaatgacagtaagaaaaagattgcggagagtataaaaaaatctgattaaaaaagatccccggggcatatgccctggggatcagctgtttcatataaaatttaaaattttattctccgaaatatctcttaagcagtccagcgaatgcttttccgtgtcttgcttcgtctcttgccatttcatgaactgtgtcatggattgcatcgaggttagcagcttttgcacgtttagcaagatcgaatttaccagctgtagcgccgttctcagcttctacacgcatttcgaggtttttctttgtgctgtcagtaacaacttcgccgagaagttctgcgaatttagcagcatgttctgcttcttcgtaagcagctttttcccagtaaagaccgatttccggataaccttctctgtgagcaactcttgccattgcaaggtacataccaacttcggagcattcaccctggaagtttgctctcagatcagcgaggatatcttcgctaacaccctgagcaacaccaacaacatgctcagcagcccatgtcaggttctcgtcctgttttgtgaatttggaagcaggtgctttacatactggacagacttccggagcctcgtcaccttcatgaacgtatccacatacactacatacccatttagccataatcgtaatctccttttcttaattaagttagttttgtttaataatagtaattattctcaataactgtagcttcaatctatcatatcaaatagttaaagtcaagcaaatatcaaaaaatacatcatttgttcacacatttcggacatatcccgaaaaagcgtatatcacaatctgaaatcttaccaggaaagtttttgacagctttttctgcaaggctgtttaaatcctcggtttccagatcaagaacctgtccgcattccttacacatgaagtggcagtgtggagtaacgcatccatcaaaatggtcagcacctccaaaattggacagcttctgaatctctccgatctcagataagagagaaaggttgcgatatacagttcccagactgatgttgggatatattttctttatattttcataaacaacatctgcggtaggatggtctttgcgggtcataaggaagtccttgatggcttctcgctgacggctgtattttaaggttgccatatatcgtttcctttctacaatttattaaccgaaatatctcttaagcagacctgcaaatgctttgccgtgtcttgcttcgtcttttgccatttcatgaacggtatcgtggatcgcgtcaaggtcagcagcttttgcacgttttgccagatcgaatttaccggcagtagcaccgttctcagcttctacacgcatttcaaggtttttctttgtgctgtcagtaacaacttcaccgagaagttcagcaaatttagcagcatgctcagcttcttcataagctgctttctcccagtagagaccgatctctggataaccttctctgtgagcaactcttgccatagcgagatacataccaacctcagagcattcgccctggaagtttgctctcagatctgcgaggatatcttcgcttacaccctgagcaacaccaacaacgtgttcagcagcccatgtcaggttgtcatcctgtttggtgaatttggaagcaggagctttacaaaccggacagacttccggagcagcgtcaccttcataaacataaccacatacattacatacccatttagccataatcttaatctcctttacataattgaatttttgtttatttgataatagtaattgttattatttctttgctgtgactatactgtaccataatggttcacttttgtcaacaaagaaattggattttttttatacagattttctggtatgatagagagaaagagaaatcctaagaaagtcttaatattttaccccatagatattaattcttaacagttatagtaaattcataaaacacaggaggcaggggaaagaaaatggctgagatactggtatgcgatgatgataaggatatcgtagaggcaatagaaatctatctgacacaggaggggtatcacattctgaaggcatatgacggcgaacaggcaatacaggtattgcagaataataaggtagatcttctgatcattgatgtgatgatgccgaaactggacggaatccgggcaacgttaaagattcgtgaaaaaaatgtgcttcctattatcatcttatctgcaaagtcagaggatgcagacaagatcctcggactgaatgtcggagcagatgattatgtgacgaaaccttttaatccgcttgagctggtggcgagagttaaatcacagctccgaagatatacgcagttgggtgcgatggcagaaaaaaaggcaaatgtttacaggaccggcgggcttgagattgatgatgaccgtaaagaagttacggttgatggcgatgttgtcaaactcacaccgatcgaatacaggattcttctttttctggtacagaatcagggcagagttttttctatcaatcagatatatgagagtatctgggaagaagaagcgattgctgcggacaatacggttgctgtccatatccgtcacatcagggagaagatagaaatcaatccgaaggaaccacgctatctcaaagtcgtgtggggacttgggtataaagtggataaaatttaatcttttgcaggaatctgtagaaaactcctgtgtttgcaatcggagaaatcagatggattcatccgggaaaggaaaggggtataaatgaagacaaggtggtatagaaagagtggtatcaagggacttctggtgctgctgacggtattttttatggtagcagcctgtgcgggggccggggtatccgtgatgatcatgaatacgggtgtccagcctttggacagcaaggattatgtggattcccagagctttacagataatgtgtataatctttctcatacgatcgttgatgcgattaatgagcggcatattttggatcaggcggatgatgaggaattgattgatcttaaggagctgaaccggggagatacactgacacacaaaagcacatcgggacttgcgtacagggcaggtgacctgtatgactgggcaaaaagttcatcttgggatacaagcacaaacgttctgatctgccgtcagccggatggcagcgattattatatgtattatagagattttgcagataagattgctaccggggaactgaaatttgtctttggcagtgatgaagatgaggggacagagaatacaaaggatatactttccatgctctcaggtagagagtatacgtattatggttatgaaagtgataatataggaattcgcaataacggtgtggagtacgttacagatgcggatggaaatgttgtctatacagatgtgtacaattatgaatccagtggaaataatgatgcacctctgaaagaggtatacaagccggacggagctgacagcatcctggatgttgtaaataataataaagaatggaaaggaaatctcaacaaggcatatcagtatttgtatgaagcactggtacagtacagtgatgcttcctatggtgaaaaaatcctgaaaacatatgcatcgggagcaacgaatgtcaactatatgtacgtagacacaaagtccggtaaagtatacacaaatataaaagatgttacatcatcgaattatctgaaaacgctggataaactgacttccggagccggtccgtttatgctgatcgctcctgatatacaggattgtgtattgggcttttccaatatttcggactggacagtatcttactggcagaatatgctcgaaaatacaggacttgccggagaaaattatctctattttgtttctgtggataaagattttcctgtgttagacaggatcaagcaggaaaaactcgtctatgataaatttgagccgtggctggtgccggttatggcaggttctgtgctggcattgattctggcacttgcaggagttgtgctcatgacgataggagccggacggaataacgaggataaaaaagtacatctgaacttttttgacagatgctacacggaaatcgtagcagtagtggtatttatgatatggctgatgggtacttctgtaattgttcaggcaatggatgacgaagaaatgcgaatggtctggaaggcgattggatttggcactttaggactctggtttggaatatggttcctggccggatggctcagtctggtacgaaggatcaaggcgagatcgctctggagagacagcctgttgaggcatatcctgctattggtaagaaaatgcttttcgaaatgcagtgatctgcttgtctttcttggtggcaatatgatcagcagagtaaaaataattctgttatttggaatatttatatttttacagtttatgtttaccgaaatgacagttgagggtggttcagcgctttcgttgcttttgatgatcgtaatggactgtgcagttctttattatctgatcaaaaaagcctggggaagagagcagatcatagctggtctgaaaaaaatcacggatggtgaccttcaatacaagattccaacagagaagctttctggagaacaggagatggtagcagattatatcaaccatatcggtgaaggcctggacgcagcggtagagaacagccttaaaaatgagcgtatgaaaacggaactgatcaccaatgtttctcatgatatcaagactccgcttacttcaatcatcaattatgtagatcttttgaagcgtgaaaatccggaagatccgaagatcaggggatatctggaagtgctggaaaacaaggcacagagacttaaagtactgactgaggatgttgtagaagcatctaaagccagcaccggcaatattgcactggaaatgacagatctgaattttattgaactggtacatcaagtgatcggtgaattcgaagagaaatttgaagaaagaaacctgaagatggtggtccatttcgatgaagaagaagcaatcatctgtgcagacggacgcagactctggcgagtactggagaatgtttttggaaacgtatcgaaatatgcaatggaaaatacgagagtctatgtggatgtaaaagttgatcgaccgaatgtgcagctttccctcaaaaacatttccgcacagccactgaatatctccgcagaggaattaacagagcgatttatccggggggatgtttcacgaaatacggaaggcagcggcctgggcctgtcaatcgcgaaagaccttgtacagcttcagggtggagaatttaaactgtatcttgatggagatctgtttaaggtgacgattgaatttaaaatgaaatagttggcgtaatataaatacagctttactgatagaatatttatcagtagagctgtatttttcttattacacctgtatccggtccgccacttcatttccaaccgccagccggcgattattgcttccgatgatcagccagtcgcggcatttctgaataacctggatggtgctgccttctttgatgtccatgtttctcatagtttcaaggatttccggaacaccgaacatccattttatggtgcaggtatcgcctgtgtttgtctgtgataaagcttgcataaaaatccctcctttggggaaaaatagaaatagttagtgtcagataatttaagagctacttcttgaatttataatacaactcagaatgtatgttcgtcaattggaacatcaggtagtcaattctgatgttggatagcatatactgacgatagatagtgtgtactaaatatgcagaattatgcatatttattgcgattatccataaagagtttattgtcctggaaaattggggcgagattgtttcggaaagaggggattacgaggatttgctgccgaaattcgcagtttacaaatatgggtaaatatgctactatttctaaagaagcggaaacatgaatttccgcagaatataagcaaactcaacgaacaagagagtacatttgctgaccacattacagagaattccccaaaggaagagctgctattctacaagcaaaagaataggagcagaacgaaaaaggattgttcactttctatggctgagagggaagtgccggtgcagatggaagatggcttgggagaggtgcagtcgagatgagattcacattcagactgcaacaggaccgcctgttatagcggaagggtatcaggacaatggcagattatcagatcattacaatagtggtcggagtatttgtatggaatcgtacccgataaggtttctgaccgcgaggcaggaacaaacagaagtggtaacacgggcaggactcgtcttctctatataaatagggagggcgtttttttataccctgggtttcaaaggttaaaatgctgttcgtgcttgcacgataatccgtagggtattactataaaatatatgaacgaggaggaaataaaatggataagcagaaatactatatcacaaccgcgattgcctatacatccggtaaaccgcatatcggcaatacctatgaggtcgtattggcagatgcgatcgcacgttacaagagacaggaaggatacgatgtatttttccagacaggaactgacgagcatggtcagaagatcgagctcaaagcagaagaagcagggatcacaccaaaggaattcgtagataacgtatccggcgagatcaagagaatctgggatctgatgaatacatcttatgacaaattcatccgtaccacagacgctgaccacgagaaacaggttcagaagatctttaagaaaatgtacgcaaaaggagatatctataagggacattacgaaggaatgtactgtacaccttgtgaatctttctttacagagtcacagcttgtagacggcaaatgtccggactgcggacgtccatgtgttccggcaaaagaagaagcatacttcttcaaaatgagcaaatatgcagaccgcctgatcgattacattaatacacatccggatttcatccagccggaatcacgtaaaaacgagatgatgaacaacttccttcttccgggacttcaggatctctgcgtatccagaacttccttcaaatggggtattccggtagatttcgatccgaaacacgttgtttatgtatggctggatgctctgacaaactatatcacaggaatcggatatgactgcgacggcgaaagctccgaacagttcaacaaactgtggccggcagaccttcatctgatcggtaaagatatcatccgtttccatactatttactggccgattttcctgatgtcactggatctgccgcttccaaaacaggtattcggacatccgtggctacttcagggcgatggcaagatgagtaaatccaaaggaaatgttatttatgcagatgaacttgtagatttctttggtgtagatgctgtccgttatttcgtacttcatgaaatgccgtttgaaaatgatggtgtgatcacatgggaactgatggtagaaagactgaattccgagcttgcaaacactctcggaaaccttgtaaaccgtaccatctccatgtcaaataaatactttggcggcgtggtagaaaacaaaggtgtcgttgaaccggttgatgaagacctcaaagcatttgcactggctgttccgggcaaagttgctgagaagatggacaaactgcgtgttgcagatgcaatgacagaagtatttacgctgtttaaacgtctgaacaaatatatcgacgagacaatgccgtgggcacttgcaaaagacgaagcaaagaaagaccgtcttgcaactgttctttataatctggttgagggaatcacaatgggagcaactcttctggaatcattcatgccagagacaacagagcgcatccttgctcagttaaatgcagaaaaacgtactcttgaagaccttaagaccttcggactctatccgtcaggaaacaaagtaacagagaaaccggagatcctgtttgcgcgtcttgacctcaaagaagtgcttgcaaaagtagaagaacttcatccaaagaaagcagaaccggttgaagagaaaaaagaagaaaatgtgattgatattgaagcaaaaccagagatcacatttgacgattttgggaaacttcagttccaggttggggagatcattgcctgtgaagaagtgaagaaatcccgtaaacttctctgttctcaggtcaagatcggaagtcaggtacgtcagatcgtatccggaattaaatctcattacagtgcagaagagatggttggaaagaaagttatggtcgttacgaacctgaaaccagccaaacttgccggaatcctcagtgaaggaatgattctctgtgcagaagatgcagatggaaatctttctctgatggtgccggaaaaagaaatgccggcaggagcagaaatctgctaaatataagatagcatttgaatagttagtgtaaataaaattatagtaactgaaagtctgatcccctgtgtatcgtgaaagcgaacacgggggatttgtttttgtattatacttgcgaagcaatatggtttatgggtatactgtagataattaatattgcagataacagtcaggcgtaagatcagacatgtgtccaaaataatctgcgtaagatttcagggaggaaaaagccatggaaaatggacttacacattttgataaagaaggaaatgcagtgatggtggatgtttccggaaagaatgttacttatcggactgcactggcaaccggatatattgcggtaggtccggagatcatggcatgcgttacggagggaaatgtcaaaaaaggcgatgtccttggcgtggcgagggtggctggaatcatgggcgtgaaaaaaacatctgaattgattcccatgtgtcatccgcttccgattcagaaatgtgcgatcgattatgaactggatcaggaaaagaaccggatacatgttttatgtaccgtaaaaacggagggaaagacaggtgtggaaatggaggccctgactggtgttcaggtaacgcttctgacaatttatgacatgtgcaaggccatcgacaaacacatggttatgtcagagattcatctgatagaaaaaacaggaggaaagagcggagattttcgttttgaggaagaacaatgattgaccgttgtgggagaaatatagattatctccggatttccgtgacagaccgttgtaatctccggtgtatttattgtatgccggaggagggaatccggctgacagagcgagaaaaaatcttgcaggagccggagatcattcgcgtatgcaaagtgatggcggaacttggaatcacaaaaattaagattaccggaggggaaccattagtgcgttcgcggattccggaactgatttaccagataaaggaaatctcagggattgagaaggtcacactgacgacaaatggaatccttctgaaaggacagatgaaggcactcgcagaatccgggctggacagtctgaacatcagccttgatactctggacagagaatgtttctgcaaaattacccgaagggatcttttggatggaacacttgatggaatcaaagaggcaatgaaatatccggaagtacagttaaagatcaattgtgttccactgggattggaagaacaggatctttgtgggatagcagagtttgcacgtaaaaatccggttcatgtacgttttattgaaatgatgccgattggatatggaagttcttttgcaggaatgacacaggaaaagattatgaatttggtggaacagaaatttggaaaaatgattccatataatggaaaacctcttggaaatgggccatgtacgtattatactgttgatggatttgagggaaaaattgggtttatcagcgcaatcagccataaattctgcagccagtgtaatcgtatacggcttacgtcacagggatatctgaaaacctgtctgcaatatacggcggtacgtgatctgcgtgccgttctcagaaacggaggaacagatgaggagctgaaggacaggatcagagccgcactggcagaaaaaccggatggccatcatttcagagaaaaagcaaaagaagacgatacagagagtttgtgcatgtcacagataggaggataatatgaaacgcgcagcaattataacagcaagtgattccggatacaggggagaacgggaagatttaagcgggcccgcgatcagggagattctggaaagagaaggatatgaagtgatttccatggatatccttccggatgatcaggtaatgcttgcaggtaaattgcaggaaatagcagattcagaaaaagcagaattgattttgacgacaggtggaactggtttttctgagagagatgtaacgccggaagcaacagaggaagtcattgaacgtaaggttccgggaattccggaagcgattcgtgcttatagtatgacgatcacaaagcgtgcaatgttgagccgtgcaactgcaggaattcgaggaaagacactgatcatcaatctgccgggaagtccaaaggcagtgcgggaaagtctggaatatatcattgatgcactgggacatggaatagagatccttacgggcgaagccggtaattgtgcacgaaaataataatatagaaaaatacagatgaccagtccaggactggtcaattgtaatataggagaatttgattatgggtaaagtgatcgcagtctgtatcagtgaaaaaaaggggacgcagaaacatccggtagaggaagcagaatttgtagaggactggggaattaaaaatgatgcacatgcaggcaaatggcatcgacaggtcagccttctgtcttatgaaaaaatagaagcttttcgtgcgagaggtgccgaagtagaggatggagcgtttggagaaaatcttgtagtgcaggggtttgatttttcatcacttccggttggaaccagatttcgttgtggagaagttgttctggaaatgacgcagattggtaaggaatgccatcatggatgtgcaatctttcagaagatgggggattgtattatgccgcgagagggtgtttttacaagagttctgcatggaggaagcatccgtgcgggaatggagtttgaacagattgacggagtaaacagagatgagagtttatgattgaggagcggaaagacggatggaaacacatatgatttttgagacacatgcacattatgatgatgaggcttttgaacaggacagagaggcattattgaattctatggaagcacatggaattggacatattgtaaatgcatgtgcatcgatcgagagtctgaaagcgacagaagaactgatggaaaaatatccctttgtctatggcgcctttggaattcacccggatgatgcagaaaagatgacagaggatacattgaaggagatccgtcgtctgtgccatctgccaaaggcagttgcgatcggagagattggattggattattactggcataaagaagaacgggaacatgagattcagaagaagatgtttcgcgcacagatggagattgccagagaggaaaaaatgccgtttatgatccacagcagggatgcagccagggatacgctggagctggtgaaggaatgcatgaaagagggaatgcatggagggattatccattgtttttcttatggaaaggaaatggcaagggaatacctgaatatgggactttatcttggaattggcggagttgtgacgtttaagaatgcgaagaagctgaaggaagtggtggagtatgcgccgcttgagcagcttgtgttggagacggacagtccgtacttaagtccggagccgaatcgtggtaaaagaaacagttcgctgaatcttccgtatgtggcagcgatgatcgcggagctgaaaggaatcagcggcgaagaagtgatcgctgtgacagaggagaatgcaaagcggcttttgttccggaagtgagaaagaactaaaaaatataattaaaactcctgctatgtattcagcaatagacaattcagaaattcagaagtactagcaagaaaaaatattattaaaagcgtatcaaaaaatgatgaactcgctacgctcagacagcatcattttttgatacaacataatattttgtctttaagtacttctgcaaatttcttcaggcgtctatttgcccgaatacatagcaggagttttattttacaacattgtaattttttctcagcttccggaacaggtggtgagcctggaccggaagaaggtaggtgttagtattcagagtcgtctgaatagtcggagtcatcactgtaatcagactcatcgctgtagtcggatccatcggagtcatctgatgagtcactgtaatcgtagtcgtcagacgagtcggaactatcatcagaactgtctgaggagtcatcagagctgtcggagttatcggcagcggtatcatcctgggcgttggctgcacttacagaccaggtatcgtctacgtattctccattggagtttaccatatcgccgtcggagttgaaggttacatcaaggagatcggtgttggtggaaggttttacgctcagggacatgatttctttaaagcgggcctggagattggcaagtgtaaaggaatcatctccaaggactgttcgtacttcatgctgtgaagcaagttcttcggtgtaatcggacagcatgtacggactgaatacgccggcatctttgttgtaatgcattaccattggctttacttcaggatccaggatttctacggttgtttttccgttctggacggttttctggatagtgaagcagcccattccttcgagaagtgcatcaaaggactcctgagtggatacgaagtttccgagtgaatagaagatcagcatactgtggccttctttatcagacatagttccgtatggctgaagggtatgcggatgaccgccgatcacaacgtcaacaccctgctgcataaggaaggttgcccattctttttcgtattcagtaggcattggttccatttctttgccccagtgagcgacaaagatcaatacatcgctgttttctttggctttctggatcatggaagctactttgtctttttcaaagatgtcgatcatgtattctttgccttcgccggcaccggaattgttggtaccatatgtataatcaaggaaagaaatcttaataccgtttacctccagcactttgacggaatttgcatcttcttctgtctcatggattccgagaaccggtacatccggatggctggttttccagtaattcagtgtctgtgccatatagtcatatccgtagtcatcgatatgattggttgcagactcgattacatcgaatcctgtattgaccagtgcatcaccaacttccgtcggagttgcaaaggatggataaccactgacagcatcatggtctgttgtaaagacggtttcctgatctaccatggcaatatcggcagcctggatctcatctttgacattttcgtaaattttgtcatagttccatgtaccggagtcggatttgccggattcaatcagtgaatcatgaaagagattgtcaccgactgcgacaacagttgcagtggaaatttccggagctttggcagctgcctcggctttttccttttgcttggctgcttcttttgcagcctggtctgcaggtttctggatcagttgataatcaagctggtgaaaaacaagaaccagaaggagcatgactacaatggaacagatcaggccaatgcgggaattgatctgttctttcaggtttaaggggatgtttttgttttttttcataataaattcctttgtgtattttgtgagacttaaaaaagtctgtttatgttcaattcaccattatagcaaatagattactttaaagaaagaattaagtaaaaaaaataagtgtaaaaatactttgtgcttcaaataaagatacgctataataaaaaataacgaatacagagagactgcgcccaggggtcaggaagcggaggagagacgcatgaattcatatgaaacagtgaataatattctggtgaggttgtttaaagatattcttgatattgaagaacgagcactgatcacatcagaatataaagatatatcagtaaatgatatgcatattatggaagcgatcggtatacaggaatccaagaatatgtctacagtggccaaaacaatgtctgttacagtgggaacactgacgattgcaatcaaccatcttgtgaaaaaaggctatgtagaacggaccagaagtgaagaggacaggagagttgtcctggtttctctttcagaaaaaggagaaaaagcttatcttcatcataaaatctttcatgagaagatggtcatggcagtgcttgacagcctgaatccgcaggaaaccaaggatttaacgaaagcattgttgaaactgcagagattttttgatgattacggaaaagagtaggaggtgcaaatagctgcacctcctttttgtatctgaatttacagcggcagaatggccgttttctttgactgtcagtttttggagatgtttctgcatgtatttttgcagtactggaaactggacaggaccgatttcaagaagatattggtgaaaaacttttggattaaagttgttgccgagtacagtttgccattctgtcttcagatcaagaaaacagaggtatccccagcagtatttcagataattggcgggcgtttccacgatatactggtagatctcagatattgcatttgtatttgtgattccaaaaagtttcagcaatctggcggcttcgtcctgactccagccataataatggatgccgatgtccagaagggaatagatgcacagattaatactgcggttcagccaggtaagacagacataatcagagccatcattatcatccagataattggaagcatactgatatccataagattctatataagttgcccagccttcgatgtagccgctggaggtgatcagatagcggatatcagaaggttctgtgtttccaaagaagatagtctgatacagatgtcctggaaatccctcatgagacaaagttgtaaaaagttccaggttactgcgctggtctgaaggattaatatagatgatattgggtgttcgggtgtcaagcggaggagtcagatagaaagccggactcaggtattcctgcatggatctatgtacatagcgtacggtgtagtctgtctctggcagagccggaaaatctttaccagttttttggcagagagcagcgagaatgtcctgtggttccatttcgggaaggtcgaaatggctgttcaatttgcgaagcagagaaggattttgcttcagaattttctgtgcattgttcatatcagctgcaatctgcccggcaagtcgtttctgcatttctctgactggtgtataggagccggtctggctctttatcagatattcataatatttttttcctccatttaagtgtgcaagtccctgacttgggcggccggtgccacggagggactgcagaccaagaatcagattctgataggcaggaattaccttgttcagaagaatctgtttatgtttttggatgagaatatcctgttctttttgaggaagttttccgaaagatttcaatttttcggcgaaaatatccagcatataattggaatcgggctccttaataaagctacggcattggtccagaacacggtccagtgttgtatcactcataaaatatccctgctgtgatttttcctgttcaaaagcaagaatgctttcaaaatatggttctacagagacaagaaggttcagatagtctgcgatatcctgcttctgatagaaggcatattcggcgagcaggacgggaagttgtgcctgaattccaagactgggacttaaaggttcataaaggatggaatagtcctgatagtcagcctgtgttttgtaatacagaagaagcatgtcgagtgtgggccggttggattcagaaagaccggaggctttgaatgtctgaagctttttgagcgtttgggatgtaaaatcttctgcttcagaggaggtattggaaagggaggcagaagatgtgtctgttaattgtgaagaaggcagagaaattgtaccaagtgtagctttggggcgttgtatccctttcttttccggataagccagtgaataatgaaggttcagcatattgccggaaacttctttttgaaaaagttcttctgtaaattgctcaaaacgactgtctgcggagagtaggtgtgtgtttgcccagccaaggacagttccaagcagaaaaacgagacacaacgtgcctgcaatcagaatacgggatgttggtctgtggaaagataacttcataaagacctcgaaggagtgctttttactatcttattggaaaaaaaacgattgtatgctaaactgataggcagcagctgtgagtgaacagcaacgtagaaagtgaggcggaagctgatggaaaataatatatatgatctggcaattcttggtgcagggccggcaggaatctgtgctgcaatctatgccacaagagcaaagttaaatacaatctggctggacagaaaatttgtgcagggcggacagatcgtggacacatatgaagtagacaattatccgggacttcctggaatcaccggactggatctgggtgaggcgatggcaggtcatgcagaaaaacttggactgaaaccaaagagagagccagttctttctgttacagacgagggagagatcaaggtgatccggaccaaaaagaatgaatatcatgcaagggcggtaatcatagcctgtggagcgacacaccgtcatcttggaattcccggagaggaagaactgggtggtatgggagtttcctattgtgcaacctgtgatgcggcctttttccaggacgggacagttgcagtagtaggaggcggaaatgtggctgtggaagatgcaattcttctttcccggacttgcaagaaagtttatctggtacacagacgtgatgaacttcgtgcggaaaaaattcttcaggacagcttatttgcctgccataatgttgaactggtgtgggacagtgtaccggtatctgtggaaggtgaggacaaagtgacggcactgaaagtacgaaatgtaaaaacggatgaggaaaaggaaatttcggtggatggagtgtttattgcagtaggaatcgtgccgggaagtggaaagttcaaagatcttgtgaagatggatgaaagcggctatatcattgctggagaagatggcgtgacaagtacaccgggcatctttgccgccggcgatatccgaaccaagaatctgcgtcaggtagtaactgcagtggcagatggagccaatgcagtggcatctgttcagcgctatttgatggagtattaaagcgtaaataaagaaaaatttgacaaatctattacaattgtgttaagatacataactgttgcgcgtaaattatgtatttaacaaacgcaaaggagtaatagatgaagaaaaaaataacagcaatgttattggcaatatgttgtatcagcagtacatggaccgtttatgcagatgatttttccagtggttcatcggaggttgagattgagatcacagaagatgaggatgaggatgcggacgatgttgagatcacagaagacgcagatgcagatgatgaaatgttttctgacgggacagaaagcagtacttccggtggggatatcagtgcaatggctaatcagatcgtagcgcgggcagagatacaggcacaggaatatcagcagctgaaaaaagaagcaaagaaatatgcagatgcacaggaagtggcaagacgtgcgcaggagatcaaagaagaaactgcccgtattcgtaagcaggcattaaaggaggctgcacgaagaaaagaagaaaagcgtgtggcgaatcgccaggcagtcgcggattttgcagtacagtttgttggcaatccatatgtatggggcggaacaagcctcacgaacggtgcagattgctctggattcgtgatgtctgtatttgcaaactttggctatgagctgccgcgagtggcagcagctcagtacagtgcatcccagaagagagatctgagccagatggaagtcggagatcttgtcttttatggcagtggaatttctcatgtagccctgtatattggagatggcaaagtcgtacatgcgctgaactccaataaagggattgtaattacagattataattacgatacaccggttggtgttggaagttatatggaataaaatcaaagagttatagttctacgcaatttgtagaactgtgactcttttcttttggcaaaaattgtcgaagaaagaggggtatttagcaaattgcacaaaggctgtcgaataaagggagaaaatgtggataacgcgaaaaatggtgtaaaagttatccacatcttggaaaggttgaaaaatcgagatatttgagttatacacaaagttatccacattatccacaaaaaattaatgtggaataagagatttacataaataaataaaaaacaaatgttttggttaataatgatgaaattaagaaattcgacaaaaaaataaaaaaatctattgactttttcatagtgaaaatattaaagaattttgcattcaaaagaaaaattttaaactttcaaagaacaattatctgacaataatgcgggccgtatataggtatgatttgctgcccgggacaaaaaaagcaggaggggatcaccccttctgcttcattcgtttaataactttcaggcgagtaaattcctcacgctctttttcctcaagtgcattctggatgtccttggtaagtgcttcataacgaggaatcgtaatattcttgagagcattcgctcttttctgtgtttttttgatgtttgcagccagacggatcgcggcattttcgataccggcgagctggatagagagctcttttaccttttcgaaggcagcttttgcctgatcaagagaaactctggtgctgtagtaagcataggtaggcgtgtttgtcagctgtttgtcatattcaaccagaggaatttcagttcccataacgctgcgtgtcttgatcctcacagaatcttccacagggacagtataagaaacctgctgtacaaatgcgattccaagctccatattggctttctggagcgctgcataggcggtacggaaggtttcatcaatctgagcctgtatatccttggcttggtcgatcagttccatcatttcacggatcaggatgtttcgtttcttgtccatcagctcaaatccctgacgggaaagagccagagaatttttggcaagtatcagattacccttggtggggaaggtattcggatccataaacagtcacctccccttagcgtacagtctctttatagtacttgttcaggatttttgtatcgattcggtcgagttcttctttcggaagaagccccagaagctcccagcctttatcaagggtttctgtgatacttctgttttctgtttcaccctgtccgacaaattctgcttcaaatgctttaccgaagacaaggtaacgtttgtcaatcggggaaagttcatcttcaccgataacggaagccagagctcttgcatcgcctacttttgcatagcaggagaagagctggtttgcaacgtcctgatgatcttctctggtgaagccttctccaataccatccttcatcagacgggacagagatggaagtacgttgatcggcggatagattgcctggccatgcagctggcggtccagaacaatctgaccttcggtgatatatccggtaaggtcaggaatcgggtgtgtgatgtcatcatttggcatggtcaggatcggaatctgtgtgacagaaccggtgccgccctgtacgataccggcacgctcataaagagtagccagttcactgtacagatatcccgggtagcctttacgggaaggaatctcacctttagaggaggaaacctcacgcatggcttcacagaaagatgtgatatctgtcagaatgaccaggatatgcatgcctttttcaaatgccagatactctgcagcggtaagtgcgatctttggtgtcagcagtcgttcaacgaccgggtcgtttgccaggttcaggaacatgacaacgtgatcagaagcaccgctttcttcgaaagtacggcggaaaaattctgcaacatcgtatttaacacccatggctgcaaaaacgattgcaaagttttcatcggaatcaccgcccagagaagcctgctgtacgatctgtgcagccagcttgtcatgtggaagaccatttccggaaaagattggaagtttctgaccacggatcagagtagtcagaccatcaattgcagaaataccggtattgatatagtttcgtggatattctcgcgtgaccggattcagcggaagaccgttgatattaaggttaacctccggagttatcgcaccgagtccgtcgatcggctgaccgataccgttgaaggtacggccgaggatttccggtgaaagaccgatctccatcggatgtccggtgagtcgggtatgtgtgttgccaagggacatattgtcagttccttcaaatacctggataactgctttgtcctcataaatctcaatgatacggccgatcttctgtgttccgtcatccatatggaattcgacgatctcctcaaaagaggcattctttacaccttccagaactaccagagggccgtttatttcacttaaacctaaatattcaattgccataaaaacgttcctcctgtcagccgttcttctctaatactttgtcataaaatgcgtcgatgtcttttcggtactgttcaaatttgtctagctgattgtttggaacatcatatttaatagaaatgatgcgttcaaagatgttgtcctctttcagtacagaaaccggcatgcctcggttgataagtgctttggatttttcgtacagataaaggatgatctccatcatctcaaactgtttttccattggaacgcaggtatcttcctgatggaaggcattctgctgaaggaagccaagtcggatgactctggcaatctcaagagtcagcttctgatcatccgggagtacatcactgccgatcagtttaacgatctccatcagagagctttcctgattcaggatcgccatcagctgatttcggtcagccacgaattttggagatacatgatcgcggtaccatggtgtcaggtcttcgaggtattcactgtagcttgtgagccagtggatcgccgggaagtgtcttgcataagcaagagccttatcaagtccccagaagcatcgtacaaatcgtttggtattctgagtgactggttcagagaagtcaccgccctgtggggaaactgcaccgatgatggagacagaaccttctgtaccattgagattctgcatcattccggcacgctcataaaaagcggaaagcttggaagccaggtaagcagggaaaccttcctctgccggcatttcctcaagtcgtccggaaagctctcgaagagcctcagcccaacgggaggtggagtctgccatgatcgctacatcgtaacccatgtcacgataatattcagccagagtaacacctgtgtagatagatgcttcacgggcagcaaccggcatgttggatgtgttggcgatcagagtagtacggtccatcatcaggtttccggatttcgggtcgatcagcttgctgaagtcctccagaacctgtgtcatctcatttccacgctcgccgcagccgatatagatgatgatatctgcatcggaccatttggcaatctggtgctgtgtcatggtctttccggttccaaaaccacccggaacggcagccgtaccgcctttggcaatcgggaacagagtgtcaaggatacgctgtcctgtgacaagcggaacgcttgcagggtagcgcaaatgcgtcggacgaggaatacggatcggccatttctgagccagtgcaagctctctggtagttccgtcattcagctgtattgtgacaattggttccagaatggtgtaatcaccgtccggagctgccttgataacagttccctctgtgatactcggaggaaccatggatttatggaggatagaagcagtttcctgtgtctcggcgatgatcgtgccaggacctactacgtctccttctttaactgtgatatgtgagtgccattttttctgggtgtccagtgaatctacgctgacaccacgggaaatatattttccggaggatttggcaatctcctccagaggacgctggataccgtcaaaaatattgtggatgataccaggtcctaaaagtacagagatggcatcgccggtaccggtaacggtttcgcccgggcgaagtcctgtggtctcctcaaatacctgaacggttgtcataccttttttaaggccgatgacctcgccaaccaggttttccttacctacatagaccatctcggagattttgaatccggaatcgccttttaagtaaacgacagggccattgatgccatagatgataccagttttactcattcttcagccctccgtcaaatttgaattctctgcacattgaagcaagatttgcagaaaaagaattatcgataagtatgtttttatgtggaatttctgcgcggataccgccaataaaatcttcttttgagacctggagcggggtacctgttttctgcgcaagatcatttgctttggatttgtcggaagaagagagatagatctggatctcatcgtctccggcaaattttacagcttcgttgatcctgcggcagagatattcatcgtattctgcagtagtgataaactgctgaaccttggtcttaacttctgcaaaaagagtttctttcagttcttcctgttttctggacaagtctcttctgagagtgatctgttcggcagaaagagccttgttgacttcacgacggacatggccggtctctgcttttatctcagcttcagcattctggcggcttgtctgtttgtgatcttccagtgtacgggcaagatgttctttgtgttcctggatagcctgtgcagcatcttcgcgggcttcatcgagagaaacctcgtaaaaatgctgcagtttttcgtctattgtcatgatattgttacctcctgcctacaatttcagtccgatcgcttcattgacatatgaagtgataaaatccggtttacggccggtgccgtgtctgtcaggaatttcaatgatcagaggtgttttgtgatgcagacggacatcgtcgatgatctcaggaaattctcttccgaatttttcggtgagaagaatgatccctacttctttatctgcaattgtatgttccagagcttctttaagctcagcgcgttcatggacgacaacaccttccacacctgccagacgcatgcctgtgtaggtatcaatgttatcactgatcaaatacattttcataaagacgctccttaaagcttaccaaggatcataaaggaaatgatcagtccgtagagtgcgataccttcggccatagctacgaagatgatggatttaccaaagagagatccgtcttcgctcagagcaccgagagctgcacttgcggagcttgcaacggcgataccggaaccaagaccggaaatacctgtaacaagagctgcaccaagatatccgagacctgtagcaagaccatcagctgaagagccggcagcctgtacacttgcagttccagcgaagctgactacagtggctacaagaagtacaccgaagaacataaagcagttggcgatgagagattttttataacgttttttgtttttctctccaaggaaaaagcatccaaaaggtacgataatactgagaatcagtgcaatagctgttgtaatctgaatgatcatgttcatgatgatatcctcctgatatatgtaattttattgaatgggataaatgtccctgcggtatttaatttttatgcgctgccttcataaatggtttgaattcgcgtccgttacctgcatagaaacggctgaagatctcgtagtattccagacgaagaacctggatacctacgatcagaccttccatggcacacacgaagatgtttccaagaacgactacgatccagttcgggttgccgccattggtagcgccggcaagcatcagtacaacttccatcatagctgcgtggctgactgcaaatgcgccgatacgcaggaaagaaagtgtgttggaaaggtagctgagtagaacctcaaacagttcgaagaagctctgaacaaagaacatgcctttctgttctggtaaaatcttggatttcttttcaaccaggttggtgagtggctccttaaggaacatcagaagcagcggtacgccaaacataatgaccagaatagctgctgccggaagttttttgccagagataaacagtccgatggtcagtacgatggatccgtaaaatacgagaccggccactgcattgctgtcaaaccaggttttttcggtatcgcctcttcggatggaattgatgatgttgaataccatacagatgaggatgataaacataccaaatccaatagcgatcacaaatactgcattcagtcttccgaccagcgggacatccatcatctggttcataggcttcagccatatggccttgagtacatcttcaaaaccaaagaaactgccgtacataaatccgaaaaagacggaaaatacaccggcacagctgatgattcctgcaagatccatcttcttggtcttataaaggaaaagtccaccgaggaaaagtacaagtccctgtcctacgtctccgaacattgcgccgaagatgaaggaatatgtgatagccacaaaccaggtcgggtccatttcgttgtatgccggcagaccatacatcttgacatacatttcaaaaggtttgaaaagcttagggtttcgcagctttgtaggcggtttctgtgtggcaggtgctttctggtcttccataagacagaagatcttttcatcattctggatatctttccggaaagcaagagcgtccttttcagtcatccagccacataaaatatagaaagtattcgtgtcaccaggagtgcatgcggccagtttgcggatatcaaagctggaagagcatgcatccagtgcagctttggctgaaacaatctttgcgctgttgtcctgaaggaatttgcgggatgcctctttgttggcatccagagctttgtgaatctcacgatggcgggtgtcaagcttttcaaaagcctctgcggcggttccatggtattcatttggaataaaaatacgttcaaagtgcatggaagagtatacggcatgaactttgtgtgcctgatgctccggtacaaaataaacaccgtagacatacatttcatcttctccgcacttgataaacagagtgtccaggttatcgtagatatatttttcgaatttctgaagatactgtttttcaatacgtccgaaacgatagtgaatatacttgaaattcaaaatctctgagatatcaaagttgagatttttgaacggacggatgatcttcagcgggtccagtatttctgcatgctcggactgaagtctggacttttcttcttccaggcgtcggaatccgtcctgaactgcccggacagttttgatggccttttcgatatccatcggttccgggcttatctgagaaggatcttccagctgttcatagaagctgtcgatcgtcgaaagagcctctttgtaagggttgatctccagaaacggtgacagattggcaacttccgtaagctcggagagagcattttccaaatgtatctcatatttggaaagataagtttcggtcattctgtcaatgtctgccttgggcccggtgatgcttaaaaatttcattttttcaatcattaccatacctcccgggatagttaattgttacgaatatactgcattgcctcgtctggggccacgccataacggatacattcaatagcgatggtcagacgatttacttcgtgctccttgtggtacatgtaggaataaagcattgccacggaatagggatccttgcgggatgctttttccagagtggtacggagcatataattatagaattcttcgagattgtgggcagaaagatgatcatactttttgccgtagtacgtcttgcgaaagatctgctgggcttcttcgcgagtggaagcctctacgagtgcagtgatttcttcttttttcagcttgtaattcattggaatcagcagcgcataaatatctgcaggtgccatactgaaataacgttttgatcgagatataaactgcaggttcagcatatcaaatttttcaccgtaggcagtggtgatctgttcaagatccttgccggagaaaagcttcttacgtacgttccagatcatagaaaaataataaagatccagagccattccatagtcaaagagaagagcagtgtcatgattctggattctggacaaaggtacgtaaaactcatttcctttcagagtattgataaactcatccatagtcgtgcatgctgtcagtctgtccagatcgagcttggaatgtctgcggaaaaaatcacagtaaggtgaaacatccacggcatctgtgcttttgtgatcgaacagattggtcatgatctccttcagtacacgaatctcatagcgcctggaataaagatccaaaaatttgcgctgttccggatttgcgaactgatatattttggaaaaatctttaaagatcgaagccttgagcagtttttctatctgaccgcggtgaagagaattttcatcaagatccgcccatgctttggcatattccggagtacgtttcaaccaggccgctgcatgtgagacgctggtgaactgaagcatttcctgaatttctgattcggatatcagtttactctgcatggcacggatctttgttgatattccgctgtaggaaaggagtcttcccatatcggatcacccctttcagtatctgagaagctgttggaataagtcttccgccagctgctggtgattctgcctgtaatacgtatccagatcttcaagctgctgttcggtcctgtgacggagagacgttagttcctgatccttctgagcttccagattatccttcagctcctgtattttacggttggtttcctgttccagttctgcgtcaaagttcctgcactgctgttccatttctgccgaaagggcggctttggatctgcctgcatcttccatgatgcgctgcgctgtgatttcaatctcagataacttattaagtatctgttccatattcaccctccttttctatgatttttttggaactttatcatataatacaccttccgttaaataattgctatacgaaattgcacaatgaaaggttaaaatcttttgaaaaaaacaaataatttaacaaaaacagtcattttaattttgaatctgtttttttcggaaaatcatataccagaaaaggaaaaataacagtgccgaaccagagacggccagaccaatataaaaagtatgtggaacatatcgcagttcaattttacagatctctgtatctgcgggaagttttcaaataaaagaaaaagacgatattatttacggtacgggcaaagacagaatacaggcgttctggcttgatgttgacggatgaatcatgtatgatagaaggcagagttgctgaaaatgcgatacagatagaaaacaggagaattattttatgagattaagaaatatacctggcgcaaaagctgccattacaggaagtagttatgttgtacagaatcctgaagagtggaaaggtaaatggaagcagtgttttacaaaagaacaaccgcttcatatagaggttggaatgggaaaaggccgttttttgatggatatggcgagccttcacccggagatcaattatgtaggtgttgagatgtatgacagtgttctgcttcgtgcactgcagaagagagaaagaatggaagcagacggagaaaaactggataatctgaagtttatgtgtattgatgcaaggattcttccggatatttttgaaaaaggagaggtacaacgtatttatctgaatttttctgatccgtggccaaaggcacgtcatgcaaaaagaagactgacttccagagaatttctggctcgttacagtcagattctgacaactggtgaaacggtagaatttaaaacggacaataaagatctgtttgaattttccctcgaggaagtgacagaagcggaaggatggactcttctggcacatacctttgatctgcatcaccaggaggatatgatggtgggaaatgtcatgacagaatatgaagaaaagttttcttctatgggaaatcccatctgcaagctgattgcacgatgtgaagaataattgcatattaatatagaaagaatgatccggacaggaaatgaatgtactgtccggatggaagttacaggagtggtaactgcatgggctgcaagaaaggaaaatgccaccgacaggcattgctcgcacagttctgttatgagcatcagaaacttgaatgctgcatgcgaaaaattcgtaaaaatgcggaagaactatgtaaaatactggattccatgccaccgaaaaaagaaaaggaaaaggagaataaaaaataattaaaaaaattataaattttttcttgacttttgatcgaggatttcatataatagtccttgcgttgagaaaataaacgcgaaactttatatgatatgcgcttttagctcagttggtagagcacctgactcttaatcagggtgtccagggttcgaacccctgaaggcgcactaaggacactgtttttgcggacattgcgattgccgcggggacggtgtttttttgttcttgaaaataataaaacaaagtatttgtaaaggcaggcaatatatgaggactctactggttggaaatactgggtatattacaaatagatttgttgaggaagcatttccggaaagcctggtaatggtaatgggagataccaatatcaggaaaaatcgtaagaaaaatctgtttgtgcgtccgtttgtgaaaaatgaaaaagaactggaagatattttcagcacatatgattttgaacagatcatttatttctccaattatctgacattccatggagaaacacgtggagaagctgagatacttcgtaaaatactgcagttgtgcagaggaaaaaggaatatgcgtattgtatatctgacaggtcctgaacgtttgtatgatgttccgaccggaaaaacactgttggtttccgaaatggaaaatctgtgcagagaatacgcaaaactctataagaccactgtaaaaataatcaggtctccttatttatattcagaacagtacgagaaagatttcctgaatacggttttccgtgaaatttcagcagagcagaaaataacctttcaggaagatgagtcacagagaatgtttttcatgtcaatgcaggatctggcagaacttatgtataaaatttttgataactgggatgaggatgaagaaattctcaatatagcggatgggtttgatcattgctttaaggatctgggagataaactgacagaattgtgtcctcatcttaaggtttcatatgcacgatacagcataatggaaaatatgttaaaggatgataaaataatccgctataaatacggctggtttcctaaaatctcaatattggaagagcttccggaactttatgaacattatcaggaaagaaataatataaaggaaggccgtctggacagtttaaaacatattatatcaaaacacaaagcagctgtgagagctgctgagtttgcggcattttttattttgtttgaattgctgaatggaatagccggaaatcaggcgcagtttaaaatgatcgatcttcgtttgatttttgtcgtgttgtttggcagtacgtatgggatcaattacggaatagcagcggcagcagcagaaagcttatcacttatacgtgcgtttgaagcagaaggaagcagctggtatgtactgttctatgaaccttcaaactggattccatttatcttttattttgcggttggagcgatctgcggttatatccggatgaaaaataaggataatgtacaatttattaaagaagaaaataatttgcttcaggagaaatttctttttacccgtgaaatgtatcaggaaaccatagaggataaaaacctgtataaaaaacaaatacttggaagtaaagacagctttggaaagatttttgatatcacaagaaaactggatgtgatccagccgcaggaactatatattgaaacgatccgtgttctggaagatgttttggaaaataaaacctttggactttacacattgaatcgggaaaatggttatggacgtctggagacagcatccgcacaggtgcagggaaattatccgaattcgataaaactgagtgagtattcagctgcaatggaagaactggaaaatggaaatgtgtgggcaaaccgggaattcctggaaaattatcctatgtatatggcgggagtccggaaaaacggagagctcgtaatgctgatctgtattcagcaggtcagtcgcgagcagatgtcattgtatttcctgaatcttttcaagattctttccggcctggtggaaacgtctcttctgcgtgcattggaatatcagaaagcagtggaatatcgacagtatgtgaaaggaacgcatatattaaaaacagaatattttgaagagcggctgaaagtacagcatgatatgcgggaacagaagctggcatcttacgtattgctgaaagttgaatattcggaaatgtcactgaaggaagcagatgagattttgcgctccaaggtgagagaaaatgatgtctggggaatctcagaaagcaaagaattatatctgatgctggttcagacggataaagaagctcttccgatcatccttgcaaggctgaagcaggccgggcttgtgtgcagacagatagatgaagagcttacaggcaataacagaacaggagaaaacaaatgatccggacagtaagtggaatcgtgctgctcatcctgcatctgacggtttgtattcttatatgggcaggaatcagaagtggtatgcttaaagtaaaaaaatatttgatggtaccggtgctttttgtacctgtatggggagctttatgcgttctgattcttcatcttcaggtttttatcaaagctgaaaacagcagaaaaataggtatagaaaagcttcaggtcaatgaagagatatacaaaaataacttcaggttaagggaagaaaatgatcatgatattgttcccctggaggaagcacttctgatcaatgatccggaaaaacgcagaaagctgatcatggatattctgaatgatgatccttcaaaatatatcgaacttctggagaaggcccggatgaatgaggatgtggaggttgttcattatgcgattactgccatggtagaactgtctaaggattatgacagtaaactgcagacttttgaacgcacgtatgcagctgcaccggaggatccggttgtactggatgagtattgtgattttatggaagaatatctgcagcagggattacttgaaaaacaggtggaacatatgcagagaaatcagtacacacagcttcttcagaagaagatcaaaacagatatgaatttccacagctgtttgtgtctggcagacaatttaatgaagcttaaagattactcaggagctcagcagattctggatgttatagataaaaaatggcacagaagagaagaatactgggtgagaaaaatccagttatttgcagagcagaaaaatggcagggcaattcaggcagctctgaaacagatgaaagaggagcatatttatttgtcttcaaagagtaaggaggttctggctttttggttagattcataaagaagatcaggaattttcagtttaaggggattttgatgatcctgggctgttttatactgatcgcggctgcgctttttgcagaaagatctggggttcaataccaggaaaaaaagagacagatttcttatatagataaggataaaatcataacagaaaaagaggcggcagattcattaaaaaagacatgtctggttttgcgtgacagcagccaggaagagagtgaacaagcctggatagagtttcagcgtatttttatggatatgcgtgttggaacggatgtgattgatgtacaaaaggatacaattcccgatttggacgcctatgagacagttgtgcttctgctcagtgatcttgatccattaaaagagaaggttctggatatctgtgaatgggtagaagatggtggaagtgcaatgtttgcgctgacactgcagaagaatacatatgtgtctctgatagagcaaaagcttggaattatctcatcaggttatgagaatacagaagtggatagcatctattttgataaggattttttgatcggtggcggacaggcttatacaattgaggatccgtatgaatccgcctgggaagtggagcttgtggaatccgcaagggtttatgccagagttggagatcagagtggaacaccagtaatctgggaagaggattatggcaaaggcagatttgtagttgataattttggattatatgaaaaagcggtcagaggcttttatgctgcttcttatagtctgcttacggatgcgggagtttatcctgtgatcaatggctctgtgttttatctggatgattttccttccccggtaccgggaggagatggtacctatgtcagacgtgattataacactaatattgcagaattttattccaatatctggtggccggatatgatgtcacttgcagcagagcatggcgtcagatatacgggtgtgatgatcgaaaactatgaagatgagacagatggagaaatcgtaaaacagacagatacgcagagatttcagtactttggaaatatgatcctgcatcagggtggagaactgggctaccatgggtataaccaccagccattaagtctgtcaaatgtggattatggagatgttcttccatataagacgtggataagtatgaaagcaatgcaggatgcacttggtgaactgatccgttttggaaaagagatgtttcccggaacagagctgtcggtgtatgtaccaccttcaaatgtactctcagaagaaggaagaaaaatgctggctgaaaaatttccggagatccgaacaatagcaagtaactatttccctggtgaatacgcgtatgtacaggagtttgagacagcggatgatggaattgttgaacagcctagaatcatatccggtgcgatcattgatgattatatgcagatggcagcactttcagaactgaatatgcattttgtaaacagtcactttatgcacccggatgatcttctggatgaagatcgtggagctgcactggggtgggaaaaactaagagcaagactggatgaatatatgacctggatgaatgaatcagcaccgtcactccgtaatcttacaggttcggagttggcaggagctgttcagcgctatggtgccctgaccgtagacaaagagatcacagatcaggagatcagaattcatcttggaaatttctatgatgaagcctatctgatggtcagaatcaatgatggtacaccgggacaggttacaggcggcgaacttacaaatgttactggaaatctttatcttctgcacgcgcaggagagtgaagtggtgattgagcgaaattgaggagaaaacagtgaaaatctgtctggttttggagggatgttatccctatgtgtttggtggggtttccacctggatgcaccagtatatcaataaaatgaaagaacatgaatttgtattgtgggtgattggtgcaaaggcagaaaacagaggaaagtttgtttatgagtttccggaaaatgttacggaagtacatgaagtttttctggatgatgcgctgaggatgaaggataccggcaggttaagacattcattttctgacgaagaaacacagtctctcagggaattgatgctctgtgggagaccggactgggaaattttattccggctgtatcatgataaacatatgaacccaatgtcatttctgaagagtgaggaatttctgcagatccttatagaatgctgcgaagaacactatccgtatattgcatttgcagacgcttttcataccatgcgttcaatgctgctcccggtgctgtatctgatggggacagaagtgccgaaggcagatgtataccatgcaatctgcaccggttatggaggtcttcttgcctgtctgggaggttatgtgaacaaaaaagacgtgcttcttacagaacatgggatttatacacgtgaaagagaagaagagatcatccgtgccaaatgggtggtgccatcttttaagaaacagtggatttcttttttctatatgctgtcagatatgatatatcagagagcatttcgcgtgaccagtctttttaccaacgctatgcatacgcaggtaagcatgggttgtgataaagataaatgcagagtgatatctaacggaatagactatgaccgactgtcagggattccgctgaaagagccagatggctggattgatattggcgcggtagtaagactggcgccgatcaaagatatcaaaacgatgatatatgcattttttgagttgtcagcgcggttacagaatgtgcgcctgcatatcatgggaggcgtggatgatgaagaatatgcagaggaatgctatgcgctggttgaccagctgaaaataaaaaatattatttttacagggcgtgtagatattgtcaaatatatggaaaagctggattttacgatacttacaagcatttcagaaggacagccactatcggttctggaatcctttgccgcaagacgtccgtgtgtgacaacggatgtcggatgctgcagagaacttcttgaaggaagcgagggggactcttttgggcgggccggatattatgtggcacctatgtatcgtgagggtctggcggatgcaatggaaaagctgtgtgtgtcggagccaagacgaagaagaatgggagaaaatgctcagaacagagtgaaaacctattacaaacatgaagacatgatggagaattatcgtaaagtatacagggaggttgaagagaaaaatggctggaataggatttgagctgaaaaaacttttcaacaggcgtggactgtttgcggcatttcgggcttacggatatgccggagttgtatgtaccggaccaatgctcctgggagttgtgcttcttcttggagttatgtttttgtgtgatatcacaggcagttcaagacacagcagagagcttctggtatgtatgatcacatatactctgctggcatccctgaccgtcacaagttttctttctatggtggtcaccagatttattgcagatcagttgtatgaagaaaattatgaggcagtactgccttcgttctggggatcttcagggcttatgctgattgtgggaggtattctttacggagtctttctcatattttcaggagccggactactggatggatttctctgttttggattttttggagagctgatcattacctggaatgcgatgagctatcttactgcgatcaaagattacagaggaattctcttggcttttatagcagcgatcgtggtgacatttctgacagggtggattcttcttatgacagggattccacatgttgaggcattgctgattgctgtttctgtcggttatggtgtaatgatggtgtgggatgtggcacttctgtatcagtattttccgtcgggaaatgtaagcgcttttttctttctgagatgggtggatcagtttttgccattggcatttacgggtctttttatcaatatcggattatttgcgcatctggtgatcatgtggatgggaccactgcaggtaaaagtacaggggctttttgtcggggcgccgtactatgacgttccggcgttgatcgcttttcttactatattagttacaactgtaaattttgtggtttcagtagaggtgaatttctatccgaaatatcgaaattattacagtctgtttaacgacaagggtgcaataggagatattaaacaggccggaaaagagatgcgaaaagtcttaaatatggaactaaaatatacggcactgaaacagctgctgactacggctctggtgatttcggtgggaggtatccttctggagtatctgccgcttggtttcaacgatctgatggaaggatatttccggacactttgtgtgggatatggcctttatgcggtagcaaatacaatgctgcttctcctgttatattttacagattacaaaggcgcattgtggtcttccgggatttttgcggcaggaacttctgtatttacgataatatccctgtttttcccacaggtatattatggatttggttttctggctggatgtgtggcgtttttcctgttttcagttttgagactggattactatacaaaaaggcttccatattacatcctgagtgtacagccggtggttcaggaggacaaaacaggtatattcacagaacttggatattttcttgataaaaaactagaagggagacaggagcttgagaaaatataaaaaagcagcaggattgctggcagtatccctggtcatttcgatgtgcagcggatgtgttatggacagagaaaaaagcagcgaaagtcaggcaggtgaaacagcgaatctgacggatgaagatacagaaataaaaaaagctgcgaaacaggacatcaatgaagtacatctgagagataaagatactttatacgaaaatgatgatgagaccagtgtggtgacaatgtatctgactgtttcgagaggaaatgtatcggagaatacagatcattcctggaaggaaatcaacaattattcggtatacgactatgatgctatgggagtggaacgttatcaggctgcggctcttctgcaggtcggggatgaagatggtccacaacagggagcggtcggttatggagagactgcgccaaatgccacagtgcaggtccggggacagacatccagcgaaaatacacagaagaattacaaaatcgagctgaaaaaaaacaaaggaacctggcgtggacagagaacgatcaatctgaataaacatatgggcgaaggaatgcgtttccgaaataaactggcctatgatctgatgaagaaaatcccgcagatgctttcactccgaacacagtttgtacatttgtatgtgaaggacaatacagatggaacgagtgacagctttgcagattatggattatatacgcaggtagagcagctgaataaaacaggaatgaaggctcatggcctggactcgaatggacagctgtacaaaattaattcttttgaattttatcgctatgaggacgtgatcaaaaaagaagatgatgcagattacgaccagaaaaagtttgaagaatatctggaaataaaaggaaattctgatcacagtaaactgatagagatgctggacacagtcaatgattactcgataccgattgatgagatcctgaaccagtactttgatacggaaaatattacctattggatggcatatcagattctgaccggaaatgtggatacgcagaacagaaatacttatatttacagtccgcttaattctgatacatggtactttatcagctgggataacgatggttcatttatgaggacagaatatcaaatacgacagtttgcggatcaaggcagctgggaatccggaatcagtaattactggggaaatgtcttatttcagagatgcctgaaatcacagacattccgagataaattaaatgatgcgatcctggatctgaaggaaaattatcttacagaggacaggctcaccacgatgattgagagttacaagagcgttgtaaaaccctatgcgtattccatgccggatcagatgaatgagcctctgacggaggaacagtatgagcaggtggcagctgcaattcccggagaggtggagacaaattatcagctgtatctggaaagcctggaaaagccgatgccattttatattggagtaccggttatagaagataataaactgaagctgatctgggatgtttcctatgatttggatgcagaggatattacatataccgttgaagttgcaagagattatctgtttcaggatgttatttacagctcagagaatcagctgcttccagaaatggagatggatgtaccagaagccggacagtactttgtcagggtgcgtgcaggcaataaatccggatacacacaggatgcctttgattattacgtaacagattccggcaagaattatggaatgaaatgcttttatgtcacagaagacgatcagattgaggaagatatttatgatgaaaagtaagaaagagttatttcgaaatgagtggaaatatctgatcagtgtgggagaaaaagaacttcttcgtctgcgtatgtcaccgtttcttcatctggatcctcatgcagatgaagggggatatatgatccgaagtctttactttgatgattactggaacagtgcgtatgaggaaaaagaagctggaattctgatgcgaaaaaaataccgtatccgaatctataattacagtgacagatccataaaactggagagaaagaaaaagcatggaagctatatctttaaagaaagcgcacctctgactcgtgaagaagtagagaagattctggctggggattatgaatttcttctgaaaagccagtatcctctgtgcagagagttttatgtagagtgtgtgagcaatatgatgcgtccgcgtacgatcgtggattatgacagagaaccctggatcatggatgaggggactgtcagagttacatttgacagagatgtgagagcagcaattggaagttttgatatttttgatccgactttgccgacgcttccggtgctggaacccggaaaacttgttatggaagtgaaatttacagagatgctccctcagatcgtcagagatattctgccgcctcatgcagctgaatttacggcagtttcaaaatatgtactctgttatgagaaaacaagatatatgaatgggtttgaatactggtatgaaatacaggaaagggagatattatgagtgtaaaagacatgataaaaaagtccgtgctggaatcaggtgtatttgatcaatataatatttcgagtattctggtcgctctggttgcagcactggcgttgggaattcttatttttctggtatacagaagattttatacaggcgttatttattcaagaacttttgcagtgactctggtaggaatgacagttctgacctgtatggtaacgctggcgatcagtaccaatgttgtaatttcacttggtatggttggtgcactttccattgtccgttttcgtacagcagtaaaagatcctatggatcttttgtatctgttttgggcgatcaccacgggaatcacgtcaggagccggaatgtatgtgctggcgcttattgcggcagcaattatgatccttatgataatactgttttacagcagacagcagagagggaaaatttatattgcagttatccattacagtggagatgaagcaggagatgaggttatccgatgctttggaaaacgaaaatattttataaagtctaaaactatgcgtaaagaaaaaacggaaatggcagtagagatcttctgtaaacaggcggatatggactttatggaaaaaatccgtgcgatcgagcatgtagatgatgtgacattgatccagtataatggggaatatcatggctaaaaaaagagtgatacgttgtctgatcataattctgacaatcgtattggcagcaggagtggaaatgttctggctaagcagaagaaaaacaataaaacaatataaagaaagtcaggcggcttttggaaatccgcttatgggatatgtcccaagtgcatggtataacgaggtttcggaagatatttcacttttgtatatggatatcacatgggcggagctggaaccggaagaaggtgtttacaactgggcgtcaattgacgaagaaaatcagatttcgagatggcgaaaagagggaaagcatctggtactcagatttgtctgtgatattccgagtgatgaagaacatatggatatcccggaatggctgtatgagaagagtggagaggccggcagatggtatgacggagaggatggcaaaggttttgcaccggattataataatccgacgatcatttcctgtcatagaaaggcagtcagggcgatcggagagcattttggacaggatggtctgatcagctatgttgagcttggaagccttggccactggggagagtggcacgtgaattacagtgagggaatccagagaattccaagggaagctgtaagagataaatacattcttccatggacagaagcatttcctgatgcaatgattcttatgcgcagaccttttgcatcagcagaaaaatatggatttggactgtacaacgacatgaccggacagccggaggccacacagagctggttgggctggatcaataatggtggtgaatatgatcagacaggtgaaaagaatgtaattgttccaatgaatgatttctggaaaacagcaccttccggaggagaattcacgagttctctttcaatggaagaaatgctggatacaaatctgtccgggactgtagaaatgatccgggaagcacatactacttttctgggaccaaagattccggatgaaaactatgtggatggatataaagaagttttgaaaaatatgggatatcggctgtggatttcaatggcagaactgaagaataccgctaaaggcagcagattgaagctgacatgggaaaactcaggagtggcgccgatgtacaaggaatggccggtgtacgtgtatattgaagatgagtccggcaaacttgtcgaaaagagcaggatctcaataaaaatatcttcgctgcttccgggagaaaaagcgactacattgactgcactggaaacggaaagactgaatagtcttctggaaaagggatatcggctctcggttgggattgaagatcctatgacggaacttccttgtgttcgctttgcaatggaagctttgtaccaggaagggaaaaactatttatggtaataagtaaataaaaagaatccataaaaatccgtaaaaagaaggagggccgggcagctgtgcccggcgagtatgaaaaagaaaatatatgtaaaaaagcatttgctttatttgcttattaatatacagggaatctgtgatgaaactgtgatgagaaattgaagaaaacgtgagggatttctaaagaagaaataaattttattaaagaagcagaaaagcagctggaaaatgcagagacacaaaaataaaaagaaattagccgttgtaaaagtcctcctactcatttataatgaaaaaagattctaaagagagttctgttactgtgcacgaagtgaacagtaacgaatttatagggaaaacaggaggaaagccttgaaaaaagagttagttattgttattgattttggcggtcagtacaatcagctggttgcaagacgtgtcagagaatgtaacgtatattgcgaaatctattcatacaagaccgatcttgagaagattaaagcgatgaatcctaagggaattatccttaccggcggcccgaacagctgctacgaagcagattcaccgacttatcagaaggagctgtttgaacttggtgttccggttcttggactttgctacggcgctcagcttatgatgcatgtccttggcggtaaagttgaaaaagcagatgtcagcgaatatggtaagacagaactgctggttgacaaaaaagactccagcattttcaaaaacgtatcagaaaaaacaatcgtttggatgagccatacagattacatttccaaagcggcacctggatttgaaatctctgcacatacagcagactgcccggtagcaacagcagaaaacgcagaaaagaaactgtatgcaattcagttccatccggaagtacttcattctgtagaaggaaagacaatgctgtccaacttcgtactgggtgtatgtggatgtgccggtgactggaagatggatgcttttgttgagcatacgattaaggaaattcgcgaaaaagttggcgatggcaaagtacttcttgccctgtccggtggagttgattcttctgttgcagcaggtctcctttccagagcaatcggaaagcagcttacctgcgtatttgtagatcatggccttctccgcaaagacgaaggtgatgaagtggaaggcgtattcggaccaaatggacagttcgatttgaatttcatccgtgtcaatgcgcagcagagatactatgataaacttgccggtgtaacagagccggaagcaaaacgtaagatcatcggtgaagaattcatccgaattttcgaagaagaggcaaagaagattggagcagtggatttccttgcacagggaactatttatcctgacgttgtagagagtggtcttggcggagaatctgcagtgatcaaatcccatcacaacgtaggtggtcttccggatttcgtagatttcaaagaaatcattgagccacttcgtgatcttttcaaagatgaagtccgtaaagccggtctggagcttggaattccggaaagactggtattccgtcagccattcccgggaccgggacttggtatccgtattatcggagaagtgaccgaagaaaaagtacgcatcgtacaggatgcagatttcatctatcgtgaagaagtcgacaaagcagccgctgactacaagaaagaacatggagaagaaccatcctggatgccgaaccagtacttcgcagcgcttaccaacatgcgaagtgtaggggttatgggcgacttcagaacttatgattatgcagttgcacttcgtgcagtcaagactatcgacttcatgacagcagagtccgcagagattccatatgcagtgctgaataaggtaatgaaccgtattattaatgaggttagaggagttaatcgcgtattctatgatctgaccagtaagccaccgggaacgatcgaattcgagtagcttgaaaaatcgcggaaaagcccataaataaaggctttgcggggtgtcgaaaagaccaaatggagtgcaaatggagtttaaaaattatttttttctcttgtttatattccagattcacctgcaaatttcgtgaaatcggttattctcataaaataaaattagagtaaatatgaagaacagtttgttttgattgaagtgattttcgtcaaggcagactgtttttttgttgcctgcatttagaaaacagataccacagaaaggttctttactttcgatgagcttaaactccatgacacagtaatcacactgatggagaattaaaaaacaagaaaatttgataaatttcggaaaatgatgtccgattttgcatctgccagtacagagtatatgaagagataaatattcaaaacagaggaggtactgattatgcagaataaattatttttaaaggcagccgatatatgtgaacttctggaagtaaaacagacatcggcttatgaaatcatcggaaatctgaacaaggaactggaagaacagggctacctgacgcttagaggaaaagttccgacaaagtattttgtgaagcgtttctacggagtagaagatacttgtgagattccacaggaagagggaaaggaatggtttcatgcgtaagagaaaaatgtatttatcagtggaagacattgcagaactctttggattatcagtttcgtttgcttaccgggtagtggaaagaatgaatgccgatctggcaagcaagaactattatgtgattctcggtcgggtgccaacccgctatgtagaggacaagatctatggtctggaacatgttgagcagtatttgaaggaggataaagcggtatgagtatgatgcaggaaaaaatgtatatggatgtggatgatgtgtgtgcaattcttggagtttcaaaaacttatgcatatagtctgatgcgagaatacaacaaagaattgaaggcaaaaggctatattgtagtatctggaaaaatctctacgaaattcctggcagaaaagatttatggcatgaaagtcgaggattagcaatgggggtttacaaagaaggaaaaaactggaaagtacaggtctattacaaagactggcagggaaatcggaaaagaaaacagaaaagaggattcaggaccaagggtgaagctaaggaatgggaaagagatttcctgcaacagcagagccagggtgtggatattgaatttggaaattttctggagatttattacaaagatatggatgtccgtctcagagaaaacactatgtacacgaagcgatatattattgacctgaaaatcaagccttattttgaaaagaagattctcagtgaaattacggtggcagacgtccgtgcatggcagaatgagttgctgacgtataaggataagaatggaaaaggatattctcctacttatctgaaaacagtgaactgccagctgactgcaatcttcaattatgcaatgcggtattataacctgcaggataatccctgcaggaaggcaggagcgattggcaagagtaaaggagaaccgaaggacttctggatgcaggaagagttcaatgcttttctggagacagtaagtgataagccggagacaagaatggcgtttcttttgttgtactggaccggaatgcgtatcggtgaattgcttgcacttacttataatgacatcaatcttgaagagaaaaccatatcaatcaataaatcttatcagagactgaaaggaaaggatatgatcacgcagccgaaaactccaaagagtatccgtgtgattacgatgccggattttcttgcagaggaatttcgggagtattgcagtcatttgtatggaattatgaaaaaggaaagactttttcggtttaccaaatcgcatatggaacattgtatggctaccggaatcgagcggtctggtgtaaagcggatacgacttcatgatctccgccattcccatgccagtatgctggttgatatgggggtggctccattggagattgcagaacgccttggacatgaaaaggtggaaaccacgttgaacacttattcacatctgtatccgtctacacagagtaaattagcaggtttgctagataagaaacatgaggaagaggaggaataagcgatggctggtgacagacatggaaaacacaacacaacgaccatttcttttcgggtgaattcttatgaaaaagcaacaatcgaagaacgagtgaaagtgagcggaatgaaaaaacaggattatatcgtccgatcatgcatttacaatcaggtatgtgttgttggaaagaaagaaacaattgagattatccggtcagaaatgaaggaaatgagtttggttttggaggatgtggcaaaagatttgaagtctgaaaaaccagttatttcagaaccggttcttgatagtatgacagaacggtatcttgcatttttggaagcagcattatggatgctgaaaggttcaagttatttatgggaggataaaaaggatggaagagaaagtaatgaaggattgtaaagtgctggcattgtgttcacaaaaaggcggggttggcaagacaacaagttgcgtgaatctggcagtcggacttgcaaaagcagggaagaaagtgcttgtgattgacaatgatccgcagggaagtatgacagcaagtcttgggtatcataacccagatgaattaccaatcacactggctactattctgacaaagattgtagaagatgaactatttgaaaatacactgggaattttacatcaccaggaaggaattgatttgattccggcaaacatcgaactctctggaatggaagtttcacttgtaaatattatgagcagggaacttgtcttaaaacaatatatagaaagaatgagagaagaatacgactatatattgattgactgtatgccatcacttggaatgctgacgatcaatgcacttgccagtgtcgatgcagttattatacctgtccaggcggcttatcttcctgtaaagggtctagaacagctgatacggacgataggaaaggtgcgaagacagctgaacaaacaactgaaaattggaggtatattgatcacaatggtggataaccgaacgaactatgcaagagatatatctgatctgatttttgatacatatggaaaccagattaagatttttccacagagtattccattttcagtacgagcagctgaaatcagtgcggaaggaatcagcatatttgagcatgatccaaaaggaaaagtagcggctgcatattggcagatgacacaggaggtgcttttggatgaaaggtagaagtgcatcgaagataaaactgacatcttatgatgaattacttggaggaggagaagaaacgaacgatatccagcaggtttcacttgagcatttacattctttcgagaaccatccatttcaagtaaatgatgatgaggcaatggcggaactggtggaaagtgtgaaagaagagggaattcttacagcattactggtacgaccgctgggtgatggtgaatatgaaatcatcgccggtcacagaaggagacatgcggcacaacttgctggtcttaaagaggttccggttattatcagaaatatggatcaagatacagctgtccgtgcgatggtagacagcaatctgcagagacctaatatactcccaagtgaaaaggcatttgcttaccgtatgaagatggaagcaatgaatcatcagggaacatcaggcggtatcagtgcgaaagacattggaaagaacgcaaatgacagtgcaaggcaggtgtatcgctatatccggcttacttatctgatgaatgacctattaaacgcagtagatcgtgatgtaatcggattgcaggtaggtgtagagctttcctaccttacggttccagaacaggagatggtggaggaagtgcatgagagtaccggaaaatatccaagtctggaacaggcaaaaaaaataaggcaacatcgagaagaaaaaacgctgacaaaagagattgtgcggctcctggttataggagagcgtaaaaagaaaacaacggtaacattaaaacaggatgaaattaagaagtattttcctccagagtatgatgaacagaagatacggactgttatatgtcagcttttggaggaatggagcaatcagaatcattgataagtacgaagggagggatgtgtcatgagtataagagcaacattccattattttcaaggaatggaatgcgatatgtacagtttttatcgtattcccaaactgctgtttacaagtgaatattttaaaaatctctcctgcgaagcaaaggtgctgtacggactgatgttagaccggatgtcactgtccatcaagaaccggtggtttgatgaagaggacagggcatatattttcttttcggtggaagagattatggaaatgcttaactgtggcaggaataaggctgtgaattgtctaaaagagctggatcaggaaaaagggattggattgattgagaagaggcgaatcggacttggaaaaacaaatgttatttacgtgaaaaatttcagcctgacagaatatccagatgagccagcaatctttgattcggaagaaacaccggaaaatgtagcagagagaaaagaaaatacagagacagaaatagaagaatatgcaaaaaaagagccggaaaagcccgtaaatacacagaagtttgaaaaacaaacttcaggaagtttgaaaaataaacttcaagaagtttcaaaaacaaacttcaaggagtttgaaaaacaaacttcaagaagtttagaaaacaaacttcaagaagtttcaaaaacaaactgtaataatactgaatataattatactgaatttagtgagaatgaatcttatcaatatctatctgaacaagagaaagggagagataggatacaggagagaaatgagtatcgacagttaattcatgataatatcgaatatgagatcctttgtcagagctatggaactggacgagtagaagagctggtagagctgatgctggatgcaatatgttcgacaaagacatatcaacagatcaatggggaagctgtgcctacacaagtggtcaagagccgtttgctcaaagtcgggtatgaacacatccagtatgtgtttttcagtcttgacaggagtacaagcaaagtgaagaatatccggcagtatatgctgacggtattgtataacgctcctgcaacaatcaatcagttttatgatgctgaagttcgacatgacatgtactgggggaaggatattccagacaggtaagaactttgtgcccactgggcacgaagtttaaaaagagatagtcatatctggcagatatgctaaaataaccttgtgtccactgggcacaaagtaggaggaagaattatgttgagatttatgataaaactgccatttcgaattattgcagctcctgtttggctggtacttgcagcggtgaatattgtgctggtgttcctggttgggttatctgctggattctgctatctgatagccggaatctctgttgtgacagaagttttgagtattgggtttggaatcagtacggactggacaatgaaatcagcgattattacgacagtagtgtttgttctactcccacatatcggtatggggatagttgcagtaattgaagttgtgaaatgtggattacaggaatttatttttggatgattgtggaaaatatagtggcgctatatggaaaggcagaaataaacaatggaagaattatataaagtgatggatgatttgcttgaggtggaatttcagatgaaagcagggatggatattctgaaagaactggaagagttttatatgctggaaaaagaaaccgaaaaatcggatgctagaaaagtagctgtgctgatgaaaggatatctgcagtcgatgaagtcaaatattcgagaaatcattcgttatattgatgacacgacacttgaaaaatcaaatgataaaaagaaagataaacaggaatctgcgagcaccatatccgaggaagtgcaggaatttgtgaatctgacaattacagagcatatggggaaagcatattcagaatggaagttaaagcaggataaagagccagtaagtgagattgataagaaataccagaaattactggaaacgttatcccaagaacaggaagaagtgattacggaatactgtaatgcaatttttagcagtggagcagaaacagaagaatttttctatcgaatgggattaaaagatggactgaatctgaaaaatacggtaaaatctgtattagaaatgatatcatgaaatcggaagttggaggatacacgcatgaaaattgtaatcattaatggaagtgccagaaaaggaaacacgctgacagcaatcaatgcatttataaaaggagcatcagaaaagaatgaaattgaaatcattgaacctgacaaactcaacattgcaccatgcaagggatgtggtgtctgtcaatgctctaagggatgcgtcgataaggatgatacaaatcctacaattgataaaattgctgccgcagatatgattctttttgctacaccagtttattggtggggaatgtcagcacaattgaaacttatcattgataagtgctactgccgtggattgcagttaaaaaataaaaaagttggcacgattgttgtaggcggttctcccgtagacagtatccagtatgagctgattgataagcagtttgactgtatggcaaaatatctttcatgggatatgcttttcaaaaaatcatattatgcaacagccagagatgaacttgaaaaaaacaaggattccatgaacgaacttgaggggatcggaaaaaatttataaagcacgttccaaattcctgtttgcatatttcatcaaacggtacatattaaaattaacacaaagggagatgttagaatgaaagctcatgaatattggtctgtcggagcattgataacgatgctaggaactttttatagcggatataaaggttcaaaatcaagccataaatattttgcggcaagttctttgctttgtatgattatggctatttacacaggtcataagatgatatctaaaaacaagaaaacaaagaaagaaccaatatcattaggaaatgaagaataatacaatcaaccttgtgcccagtgggcacgaagttggcatagtcactatggtgtcaggagaaatcctggcatcttttttttatatctttttacacttcaaaaaataatttcaaaaaatttctaaaatcatgtccgattttgtcgctcccaatacagagtatatggaaggcaaattgaaaatcctctgatttccaaaaatcacaaacgtaaaagaggttcagacagttcttccgattgcaccttgacaattgaaggagctgatacatcttgaggaacatgcttaccggagataatccggctcgtgcaggcgaagactcctacgggaagagcgaagcaataatgataccaccgaagggtacaggacctctgctgaaacagagactgtgactgtatttttacagccgggttatctggaatgataacgatcagatgtatatgtacagacaaagcccaaatgtgaatacttagattttcttatttatattacaggagaaatcctgtagcaagtggggaatggttcgaatccattcctcattttttcgtgcagaaaatgcacagattattatcctgtttgaaataccagggaagggtgttgcaggaagaaagggaggacaaaaagaatgaatacgattgttttaatgggtagacttgccagagatccagaaactaagctgacatctacgcaaaagggacaaaccaaagtatctaggtttccactggtagtaaaaagaaatcgcacaagcaaagcatttgtagtgatgatcacagcttatggaaataatgcagaatttgtggagaaatatcttgaaaaaggaattaagattgctctttccggagagttggtaatctctcagatcaaagatgaacagactggaactgcatcctattataccgaagtcattatggataatgtagagtttgcagaagccaaaacaaaaaaagaagaatctgacggatttcaaccagcagagaagaggaagattccattcgatataccagaagaacttgaacaagaaatgccatttcgataggaggacaagatttatgagaaaatactttttagaattatttgcaataggattggttgattcagaaggaagaatcaatacagaacatatgacaagcgatgcacttatgacttccatgaaaacaatggaagagctgacaaaaatgaaaatggatcgtttagttttggaaacaacaatggagatgatcttatgtatgtttgagtcatgtgacacagaggaatttacagaaatattaggcaagctgcttggcggaaagcagacttctaaagtgacagctcatttggaagcactggaggaattgttgacagaagaggaatatagtagtttccttgcagaatatcttggttatttaaccgtgaatgtagcagagtttattaggagcacaatcattgaaaatggtttgatgttacttgccggttcaggaggagaagaggatggagaagaggatggagaagacggattataaaatcacagagtttcacaattcggagtttggttccatccgtatgattgaagatggaggcagacttttattttctggaatggatgtagcatttgctttgggatatgcaaaaccaagaaatgcgataaatgttcattgcaagggggccctgaaacggggcgtccttacatcaggtggggtacagccaatgatttttattccagagggagatgtatatcggctgattacaaaaagtcgtttaaagtcagcacagaattttgagaagtgggtatttgatgaggtacttccggctattaggaaaacaggcggatatttagagaccgatcttttagacagggtaaaagataacccggaacttcttttggaatttgccgagagacttttggcagaaaacaatcgaaatcgagaattgcaaaatcgtgtaaaggatatgcagccaaaagcagattattatgatcatttcatgattacaggagaatgcaccaatattcgaacgacggcaaaagagattgaatttccagaaagaaaatttgtgaaacttcttttaaatagaggatttctatataggagtccatccggcacgctgttaccctatgcggtggagaagaacaatgatctgtttattgtaaaagactattttaacaatggacatcttggttcacagacattggttacaccaaaaggaaaagaattttttaaagcgttgtgtgcggaggaagagtaaagaatgaaggaggtggttgccatgattacagatctggacagcagttaaatcgctgaaaggagggaaaatcatgcaggaagaggtaactcagaaaacggtcacgttctgcattcggactaccaaagtaacagcagatttattgaaaaaggttcttgctgcttatctgcgtcatcagaagcagaaatcggtagagaagaaagcgaagaagaatcagccgaaacagggaaaggtcacggtaaaagagctggcaaaacaaaatgccgggatggtcaatatcgagatcacaaataagaatatcaagtcctttgaacgttatgccagaaaatacgggatcaattatgctttgaaaaaagataagagtaaagatccaccgatgtatctggtgttttttaaaggacgtgatcaggatgccctcaatgctgctttccgtgagttttcccagaaacagattcaaaaagcgaataagccttctattcacaagcgtcttgcaacttacagagcaatgatgccaaagaaatcgaaggacaaagtaaagaaccggcatcaggagcagagccgatgaaaaagcaaatcggtaaaaatctgatgcaaaaatggaagaataagatcagggtcaggctgtccgccctggataaaaagaaactggttcttaccaatatcccatatatcttaactgctttttatacaaatcgggcatcatttctttacagaaacagtctgggagaagatattgggaacaagctattatatgcgatggaacatgcagacaggattcttactggattgcagccaagttttaactggcgtgatatgctgacaggaattgtagcagctgtcattctgaaattactggtatggcagaaacagtcagatgcaaagaaactccggaaaggaatcgagtatggttcagccagatggggaaacgctgaggatattaaaccttatatgtcggaagatccctggatgaatattccattaacagcaacagaagcattgactatggaaagtagacctaaacagccaaagtatgcaagaaataaaaatatagtggtcattggcggcagtggttccggaaaaactcgatttttcgttaagccgtcagtcatgcagatgaactgttccatggtcattacagatccgaaaggcactctgatcgaggagtgcgggaagatgttagcaaagggaccacctaagaaagataagaatggaaatattatgaaagataaatcaggaaaagtggtacacgaaccatatgtgattaaggttctgaatactatcaacttttccaaatcgcttcattacaatccatttgcttatatacggtctgaaaaagatatcctgaagctggttacaacaattattgttaataccaaaggcgaaggggaaaaagcttccgaagatttttgggtgagtgcgacacgttcgcaggcggtaaaaagtctgcgcacagtgttggtttattaacttaacaacaaaaaaatgccgtatttatgcggcttttggcgtttcgcaaacgcctatttattccaaagatgaaaggagaatcaggtatgagtaaaaaaatgaaaatctttacagcgggtgcgttaggaattatgatggcaggtcttgtttgtacaaatgtttacgcattagacaacaaagatgtagttggtacatggtacgcaaacagtctttctatggacggtatgaatgaatttcatccaaatgcaatcatgatggaaatgtcaatggaaatcagtgaagacggcaaaggtaaagtaacaacatcttccgaatcagaagaagcagacgttaatgattttgaatggaagattgacggagataacattatcataacctcagatgatgaagttatggaaggcacctatgaagatggaaaaatcacaatcagcatggatggaatgaccgtaactcttggacaggaaaaagaagaatataaaccttatgaacctggaaaagcactcacagacaccaaacttgaagattttgatggtgaatggagcagttccataatgtctgcgtttggaatgcaggttccaaccggaacactctttgatatgcagtttaatcttacaatcgatggcggtaaagcaacacttgtaacaattgaaagcggaacggaaaccaccactgagcttgaaggcgatctggacacaaatgccctagtattaaaatcaacagaagaaaaaaccgaagaagacaccgaagactattcattattcgatacagataccatgagattatatcttcttgacgatggcaaattatgtttcacatctgctgacagtatggatgatccagaagaaacagaagaagctgcagacggtgaagacagtgaagattccatggattggactgtaaaagtattctttgacaaattggagaaaaaataacataaattctcttactctttgaaggaggtttaaataatgggattatttgataaaaagaactgtgatatctgcggtgaaaaaattggacttttaggaaaccgcaaactggacgatggaaatctgtgtaagaactgtgccagcaagctttctccttggtttgaagaaagacgccacagcaccgtagaagatatcaaaagacagctggaatacagagaaaaaaacaaaaatgctgttcgcagtttcagtatcactcgtgaattttctgcagacagatatcatgtgtttatcgacgataacaaaggattgttcgccgtagcatttaatatgagcgaacaggataatccggatatcgtacctctgtctgcaataacctcctgtcgtttagacatcgatgaacagcgagtagaagaagaatacaaagatcaggatggtgaatccagatcttatgtgccaccaagatacaactattcttatgattacaagataaaacttggcgttaacacaccttggtttgatgatatggactttaagcttaataccttctctgtaaaagatcacgaacgagctaaaatgatgaattatgaacaacttgcaaatcagatcataactgcacttaccggcgcaccggcacccgcaccggtttatagcaatggcatgatgaaccagtgttacccgcagcagggcaacatgatgaaccagggctacccacagcagggcaatatgatgaaccagggttatccgcagcagggcggcatgatgaatcagggctacccacagcagggcaatatgatgaatcaaggctatccacagcagagcaatatgatgaatcagggttatccgcagcagggcaatatgatgaaccagggctaccatcagcagggcggcatgatgaatcagggctacccacagcagggcggcatgatgaatcagggctacccacagcagggcggcatgataaaccagggctatccgcagcagggcaatatgatgaaccagggttaccagcagcagggtggcatgatgaaccagaatacacctcagcaggcttctggtgatacatgggtatgcgcctgcggtgccacaaacacaggtgctttttgtgaatactgcggatcaccaaaaccgtgatactaaattaaaagggggaatacggaatatgtctgatgttatagaatataagtgtccatcctgtaatgcctcgatggtatttgattctaaatctcagcacatgaaatgtccgtactgcgatacggaaatgacggtcgaagagtttcagcgcacgcagaaatccgaagatacacagacgaccggaaaatcaatttcaaacgacaactggtactcaatgagcaccggtcagtggcagaatgatgaactgaacggcatgcgcgtctacagctgccagtcctgtggaagtgagatcgtagctgaggaaacaacaggagcaacgacctgtccgttctgcaataataaaataactatgaaaggtcagttttcaggtgatctgaaaccagattatatcatcccatttaaactggataaaaaagctgccaaagaaaactattataagcatctgaaaggtaaaaaatatcttcccaaagtattcaagaaagaaaaccatgtggacgaaatcaaaggcgtatatatcccattttggctgtttgatgtagatgcagatgctcagattacatatgaggcagaaaaagtccactctcatacatctggtgatacggaatatacaacacgtgaaatctatagtgtctatcgcgaaggtagcctcagcttcgatcatgttcccgcagatggttccagaaaaatggatgatacactgatggaagccattgaaccatataatttccaggaagcagtaccgtttcagcaggcttatctggcaggttacctggctgaccgttatgatgtcaacgtagatgaacgtatagacagagcccgtgacagaattcgtgtatgtactgagagagcttttcgtaaaaccgtcagaggttataacggtggtgcctcagttaaagacagtaatgtacagattcataatgccagttactggtatgccatgtatccggtatggcttttaaacaccacctggcacggtcagaaattcacatttgctatgaacggtcagaccggaaaaatggttggagatcttccgattgacaaatcaaaattctggaaatccgtaggaattcgcaccgtccttatctggggagtgctgtacggtctgaaatgtttatttttaatgtagcaggaaggaacagataatatgaagataaaaaagaaaatatggggctgcctgctttctcttctctgtatatttatgctggtacttccggtaatggcttctgaaagcccggaaacagattctgaggtttctgcagtgacttccgaagagtctgcagtacctactgagaatcctgcaattccggaagaacgtcagaaaccacttcttgtggataatgctggtcttttaaccgaagaagagagcaatgcactattaaataaacttgaagatatcagccagaaatatgaaaatgaggtcggcatcgttaccgtcaactctctggaaggtaaaacagccgaagcatatgctgatgactactatgattacaatggctacggatatggagaaaacgatgatggtctgcttcttctgatcagcatgggcgaaagagaatgggcaatctctacttatggatatagtcatactgtagcttttacagatgctggtcttgaattcatcagcggtcaattccagagcaagctttccagcggaaactatgcagatgcgttcaattgttttgcagaccagtgtgatgattttctgagacaggcagcaaccggagaaccatatgacgttgacaatatgccttcaaaagggaaggttcatcctttctggctcgttgccgatttagttgtcgcttttctgatttcttttggactcgttaaatcaaaatcaaagaatcttaaatctgtaaaaaaacaggaatccgcagaagcttatgagcgtaaaggttccatgtcgcttcgaagatctactgacagttttgtcaacaggattgtcactcaaagaactattagaaatgaaaaagacagttcttccagttcctctggcggaagctcatcacatacaagttcttccggccgttcccacggcggagccagcggcaaattctgagataagaacaattccgaaatgacaaatagaaaaactttgtcattgctcaatattcaggcattatagtataatgtagttaacaggttaccgctcaatatccgaccggtaacctgcatactttacatactttttttctggaaagggatcgtaatgccatatcataagaaaaggtttttatcatatacaattgttatattatgctttttgacagcgtatacatgcaggttaattcacaccaataattctttaatacaagctttagttgatcagagccgtaccagtatttatcttggaatgtattgtgcatgggtcatttatctgaacaaacatgttgtatataaaagaatgcgtcagtgcctgacggtaattggctgtttaatggtattctggttttttctgcgcactgtaaaataccatatttttcaggatcctcttagcacacacatttgttggtatctgtattattttccaatgatcctgattcccactttaggtttaaatgcttcctttcttttggaagaagaacatgacaaagtaaaaaagagaagtatcttcttactattctcggctatgttgctgatcatatccgtatttacaaatgatctgcatcagcaggtctttcatttttatctgaatccaccttattcagacaaaaattacagctatggatttttcttttttgtaatacagggatggattatattttgtctcattgcaatggacataatactcattcacaaaagcaaaatctccggcaaaaaacgtttctggcttccggtaatacctggtattatacttctggcatggaacattgcaaatattctccgggtgcctataatcagcaccattgcgggcgatctgactgcaatctgctgtctttgtatagctgctatcttccaaagctgcatcctttgtggtctgattcctaccaacagccgctactttgaattattccagtcaaatggcagtctggatgcagagattacagataacacttttcatcgatattactattccggaaactttccaaaacttaccgaggaattgcgtgaatgtgtgattgccaattcttcaatacaagagaatggagttttgatcaaacatattcctgttaaaggcgggcatttattctggacagaagatatttctgtacttctggatcagtaccaggatattgaagaacagcaggaagaattaaccgaacgaaaccagcttttacagatgacttatcaaaaagaagctgcgagaaaaaaattagaagaacagaaccgacttttaaatatgattcagtatcagacatataaacagtatgagctgctttcctcatatatgaaaaagcttgaacaaactgaatccagagaagaatatgatatgctcctgagtaagattgtagtcgtaggaacctatttgaaaagaagaaaaaatcttgtacttaccagatacagttcacaaggagattctcttactatggccgatctgaagcagagtcttgcagaatcctgcgaaaatctgaaactatgcaggatccgtgcagcttattatgtacaggataaagaaaagcagcttcaagcagatgatattctgaactgctatgacttttttgaatggctgattgaacagctttttgatgttataaattcagtctttttccgtgtaacccagattgacgaaaaactacagatttctgtccatgttatgagttcaacagatattcataattttctgaaagaacgacctgaacttttaatacagcaggaggaggaacaggaatggtttattcgatgtccgctctcataaatgataccataaaattacaaaatgttcttatgatccttatggaaatatgtctgattcttgaatttatcctactattttcaagaattatgcgtgctgttgaaaaatggaagatagctgtttccgcatcatggctgatcatttcttttcttattatggccggacttttgaatgaccatcgacacagactggataaacctccgcataaacctatcttttattcatttccggcatatgcattggtgatcataattgttctgctgactgtttatcttattctggcaatttgcaaagagatcaaagaatacaataatacactttctccctggtctgtttatgaagcggtaaacaatgttccctgcggtgtctgcttttcagattctctcggacgtattatcttaagcaactccaaaatgcaggagttgtgcagaatgcttactggaaactatcttcagaattttgattctttccgttatgccataaattccgagccagtacaggataatgtaatcaaattaaactctgataacaatgtattctattttcaggatggttccgtctggatgtttcaggaatatcaccttacagaaccctcactgaaaggctatgtacaaactgtcgcactcgatgtttccgaaatatattacaacagtgaagagattaagaggaacaatgaaaaactggcaaaactaaatcaaaagctggaagaaatgtatgaacgaatcggtgatgaaatacgcgaacaggaaactctgtccatgaaaatgcaggtacatgataacttcggaaggagtcttctctctatacgaaaaatcttaggagacaaaaaatcaccagaaaatatgaaggaacagttggaaactttaaagcagcaggtttatatccttaccaatacaaccgtcgctaataaagaaaaccaatatgaagataccgaaagacatgcagaagaacttggtatttccattcagatccagggcagctatccagatactcccgcataccggtgccttacagatcgcgctattcgtgaatgcgtaacaaactgtgcccgacatgcacatggaaatactgtttttgttattatgaaaaggaaacgcaacgaatatcagattcagatcaccaatgatggtgaattgccgtcaaaggatgccaaagagggtggtggactgtctgctctgcgaaaagcagttgaagcagagggtggctctatgaacacttttttcgaacctgctttttatctgttgctgaatttacctctgtttgatgaagaatactaattcaattttggaaggaaatgattctatggcacgcatactcattgtagaagatcagaagatcatgcagaaatatttcgagtttattattttacaggatccggatttaaagctcgtagatactatttcagatgcccgtgaagccgtaaagatctgcaattattctgtcatcgatctggttctgatggatgtgcagaccttccataaccatgacggcctgtctgccggaaaggcaatcaaagaagagcatcctggaaccaaagtactcattgtaacttctctgatcgatcctaaagttctggaaagagctaagaccggatgcgcagacagtctctggtacaaagatcatggtgaagatgaaatacgtgatgtgatacacaggactcttaatggagaacatgtttttccggatgtgaccccggacgtagaactgaactggatcaccagcggtgagatcagtccacgacagttagaaatgctccggctatatatctgtggtatgtcctattccgaaattgcaaaagaaatgaactgtaccacttccggagtacgctggaactttcaggaaatgattgcaaaagccggatacaactgtaaagaggatctgattgctgctgcactagaaagtaaattaatagttaccacgctaaaataaaccaaagagaggagatgacatcatgaagaaaaaattaattgcaatatgcctcagtgctttgatacttacttctgttacctccgtaaactgtatggcgaaaaatccataccctgatgaagaatcttacagcgaatccagttttgctattttacaggatatgcttcgagaaaatgactgtcagacaggaattgcttttctgggttatatcggatacgatgccacaaccgaagaaattctggattatacaaaccaagaggattatgttgcatcttatccgtttcttaaaaatggtaccatcgtggatgcgggtggttatgaagtctttgcgatcgttccggcttcggactggtcgatcagcgtatacgcctctgagatgaccgaagatgccgtctacaaagattatctggatttcccgttatatgagggttcacctgatgaagtgatcattctccgatgcaacctgagtgagatttattcaaacacaatggtcacatccaaagaaggcaatatgagcgtttcctaccgtccttccatttctttgaaagacggccacctggcagaagaacagcgttgctacgatttttcaatctactacgatttcgactatggacataatggttctgacaactgtatggaaagcaatcttcctgaagattattatgaggattattacagtgatacagtacaaaacgcttatgaacttctctgttcaactgatgaggtcagctactatctggggctgggattctttgtatggtataccggaaacaaagatatgatcgatgacaaagaatgcagagtattcgttctcggaaaagacctggacgatcatatcgaagtcaaaaatcattacgcagtcagtgataatcaggtatattaccttgatgtgattgaaaatacctggaatattcttggatccggataatgtaattcctacttcacaataccataatgcttcctgattcttgagtttatacattcttgagtttgtaccctttttggcttgaattccttttgtaaagcatatataataggaatactgtgaagaaatgtcgctgcgataaattttgttgcgaaattttcttcatgtaaccagttatataacaaccttcgaaaggaaaactatgagaaaattagcattgcgcgatgaaatacttctgcagattgataaagctgcccgttacatcggtggtgaagtcaatgcagttatgaaaaacaaagaggatgtcgatatccgttttgcaatggcattcccggatgtctatgagattggtatgtccaacctcggaatgatgatcttatatgatatgttcaacaaaagagacgacgtatggtgcgagcgtctcttttcaccgtggacagaccttgataagatcatgcgtgaagagcacattccattatttactctggaatctcaggatccggtaaaggaatttgatttccttggtatcactctcggatatgaaatgtgctatacaaacgttctccagttactggatctcagtggaatcccacttcttgcaaaagaacgtacagaggatgatccgctggtgatcggcggaggcgcgtgtgcatacaatcctgagccacttgcaccgttctttgaccttttctatatcggagagggtgaaatggtctatggagccctttttgacgcttacaaggcaaaccagaaggccggtggcagcagacaggatttccttctgaaagcagcacagattcctggtatttatgtaccttctctctatgaagttacctataaagaagatggtaccattaaatccttccagcctaaatatgaaaatgtaccggaaaaggttgaaaaacagctcgttatcgatatggataaagattacaataaactggaagctccggtcgttcctcatatcaaggcaacacaggatcgtgttactctggaaatccagcgtggctgtatccgcggatgccgtttctgccaggctggcatgatctaccgtccgactagagaacgtgatatcgagacattaaaagaatctgcaagaatcatgctgcagaagacaggtcatgaagaaatttctttaagttcgttaagttccagtgactacagtcacctgaaagagatcgtgaacttcctgattgatgaattccgtgatgaggcagtcaatatttctctgccttctcttagaatcgatgcatttgctctcgatgttatgagtaaagttcaggatgtcaaaaaaagcagcctcacttttgctccggaagcaggttctcagcgtcttcgtaatgttattaataaaggacttacggaagaagatatcctgcacggcgccggtgaagctttcaagggcggatggaatcaggttaagctttatttcatgcttggacttcctactgaaacagaagatgatatgaagggcatcgcacatcttgcccagaagattgccgagacctattatgaagttgttccaaaggagcagcgtaaaggaaaagtacagatcaatgtcagcacttctttctttgtgccaaaaccgttcaccccgttccagtgggcaccaatgttccgtgaagaagactttatcgaaaaagctaaagttgttaagaatgagattcgttctcagttgaaccagcgaagcatccgttataactggcatgaacctgatgtaaccgtactggaaggtttccttgcaagaggtgaccgccgctgtgcagatgtcatccttaaagcatatgaaaagggtgctctttatgatgcatggtctgaaagctttcactatgatatctggaaagaagcctttaaagaaactggtgtggatattgaattctatacactccgtgaacgcagcactgatgagattcttccatgggatttcattgatgcaggtgttaccaaaaaattcctgatccgtgaatgggaacaggcgaaagcagaaaccgtaacaccaaactgccgtcagaaatgctccggctgtggtgtacttaaatacaaaggaggtgtgtgctgtgaaagtaagaattaagtttgccaaaaccgggcatatgaaatttgttggacatctggacactatgcgttatttccagaaagccatccgccgtgctgagcttccggttgcattctccggtggctacagtccgcatatgatcatgtcttttgcgacaccacttggtgttggtacaaccagtcttggtgagtacttcgatatggagcttactgaaactgttccaacaaaagagattgaagaccgtctcaatgccgttatggcagagggtgtgtccatttgctctgcgcgtcaggtagaagacggtaaggcaagtaccgctatggctctggtagctgctgccgattattttatacagttccgcgaaggaaaagaacctgctgcagactggcgtgccggactggatgattttctttcccagaaagaaatcattgtaaccaagaaaacgaaacgcagtgaaaaaacggtagacatccgtccatatatttatgaaatgcatttagacggtgaaggtgttttcatgcagcttgcttctgcaagttccaactacaccaaaccggaacttgtcatggacactttccttcgttggatggatgaggaaccgcttccatttgcatacatgatcgaacgtcgtgagatttatgccaacaaaggtgatgaagaacatctgaaactcgtttctatggaatcattaggtgaagaagttgaataagctgatcattacagaaatgcttcttaacgaagttccctgtaccgtctgtgcaatcgtccaggaccagaaggtaattgaacttcgtctggagccttccgggaaaaaaaatactcttaacaatatttatgtaggacaagttgaaaacattgccgccaatattcaggcggcttttgtccgtttaagcgattccgtaaatggctatctgcctctgaatcagtgtacgaatgccatttacacagatggtcgaaaaacagatcagcccctgcgtcctggagaccagcttctggttcagatcaaccgtgaagccatgaaagggaaacttcctgcactgaccgctaatctgaatttttcgggaaaatatcttgttctgactacaggaaatcgaaaaataggtttttccaacaaactttccaaggaagagagcagtcttctgaataaatggctggaagaagaacgtagcctgccggaacgtgagtatggcatcattgcccgtacaaatgctgcagaagcttccaaagaagaattttttcatgaattggaaatgctgaaaaaacaatatgaaaaagttgccgttcatggacggaaccgtacctgttacagtcttctatatgaagcagaaccattttatctggcagcagttcgcgatgtctataccagagatctggatgagattgttactgatattcctgaaatacatgaaaagatcttcgcttatctcagcgaatttcagccggataaactgaagattcttaagctgtatcaggataaattacttccactatataagctttacagtctggagggtgcgatcgatgaagtatgccatgaaaagatctggctgaaaagtggaggttttcttgttatccagcagacggaggcgtttgtttccattgatgtcaacagtggcaaatatactggaaagaaaaaagcagaagagacttaccgtaaaataaatctcgaagccgctgctgaaattgcccgtcagattcgacttcgaaatctctccgggatcattctggttgattttatcaatatggaaaatccggatcatcaggatgaactttttcatgttcttcagaaatatctccgcaaagacccggtcaaatgcaaagcaattgatatcacgccacttcatatccttgaaatgacccgtcaaaaggttcggcgcccattgattgaagacctgagggaattaagtgcgaaataaattagatataatcttaactattttttaacactagtttcattgacttttggtcatatttgaggttataatgtttgtcggctaagtaattgactaataaagagccattacattgatttaaaaattatagtataaaggcaggtgaacagaatggataattgtgattctcacgggcgaagttgtcgcacaggacgaaagagctgcataggatgtgatggaatcattttttatcacattctgttttaatttgtctatttttcttttctatttcttatagatctgatttttattcagatactcttttatcctgttaacagatcccatgaacacaattaataaaacccaatatgacatgttgtttttaacttaaaaaggcatgccttatttgtgttcggataaataaaagaacaggagggatactgcatggaaaaaagagtgcaggactacaccagtgagattctggaagtagtaaaaagcaatgcgtcaccggcagttctgtgtcagcgtcttcaggattatcatgaaaatgatattgctgatatattagaaaagctgagcccggcagaacgctgcaagttatatagaattctggatatggatactatttccgatatttttgaatatacggaagaagcagatgttgttaaatatctggaggaaatgaatatccgaaaagccgctgcaattttatcaaaaatggatacaaatgtattatccgatgttttgcagcagtttgatcgttcaaaacgaaagatcttcattgaattactggatgacgaagttcgtcacgacatcgaaatgatcaattctttcgatgaagatgaaatcggtagccgtatgacaacaaattatattgtcatccacgagaatcttactgtcaaagaagccatgactgaactggtttctcaggctgctaagaatgacaatatttctactatttttgttattactgcatctgaagagttttatggtgccattgatctgaaagatctgatcattgccagacgcgatcaccctcttgaagaactgatcgttacttcttatccttacgtatatggtacggatctgattgatgaatgtatcgaggatctgaaagattattccgaagattctatcccggtactcgacaacgacaatcgtctgcttggtgttatcacctctgctaacatcgtagatcttgtcgatgatgaaatgggagatgactacgcaaagctggctggtctgacagcggaagaggatcttaatgaaccgctcagggaaagtatgaaaaaaagaatgccatggctggtcattcttcttgctctcggtatgatcgtatcttcagttgttggtatatttgaaaaggttgttaccaatctgccgatcatcatgtgtttccagtctctgatcctggatatggccggtaacgttggtacacagtccctggcggtaacgatccgtgttcttatggacgaatccctgacagccaaacagaaatttgaacttgtatttaaagaaatgaagattggtctctgcaatggtggtgtacttggtttaatgtcatttgcactgatcggtctgtacatttatattatcaaaggcaaaacccttatatttgcatatgcagtatctggatgcattggtttatccctgcttctcgcaatgctgatttccagcgccgtaggtacctgcattccattgtttttcaaaaaaatccatattgacccggcagttgcttccggtccgctgatcacaaccatcaatgaccttgtagctgtaatttcctattatggattaagctggatcttcctgatcgaagtccttcatcttgccggataaaccattggggacggagttagtggctttaaagagccactaactccatccccaatctttattcttctcttaatttaactgcggttgccgcctgacgccgtctggcgtcgtctaaggctgcgtaatgcttcttagtagtattgacatccttatgtcccagaacgtccgctacaaggtaaatatcgcccgtttcctggtacagtgcggtaccataggtgcttcgaagcttatgcggcgtaattttcttagtggtcgtaatctgcctggaatatttttttaccatattctcaaccgcctgtacgcccatacgtttgcgctgggcagaatagaagagagcgtgctcatgaccgacaaggggagtgattccctcacggacctccaggtatcttttgagtgctttttctacctcaggcccaaagtaaacaaccatttcatttccaccttttcgggtgactttgattccattatttttaaaatctacatcttcaatatccagtccgacacattcggaaacacggattccggttccaagaagcaatgtaacgattgccagatcgcgttcttttgttttttcataaaacacacgtttctggccggtaagtgtatcgccacagtgttctatataatccaaaagcatggcaacttcatcagtatccagacgaataatgcttttttcatggattttcggtacatcaataagcactgtaggattcgtatggatcatttcacgtttgtaataataggcataaaaactcctcaaagcggagatttttcttttcaggccacgttcaccatttgtttctgttttatcacctgactgatataatttcagatattcctggtattcctcaagatcgacagctttaatctgatcgagaacatcaaccgtaaaatcagtcatggcatgatctttgaatgcaggattttcatccagaagaaactggaaaaaaattcgaatgtcatatgcataagaaattcttgttttggcagtcgtggtcgtgtcaattgcccggaaataatctttacagaatggaggcagcgttgccagaacctgacgaagctttaatgtattttccatatctgtatgttcacggtaagttgtttttttatcgctcataaaattaaatttccccttcaatataaaagaaactataagaactataaaaatggatttacaaagggattaattatggcatttatcgaaagagcccttctcatctatatgaaaaactcgggtttgtcgtatagatatagataactctttcaaatgccatattcagggatttttctgatttttccatatctgacatttgtaaaacattttcgtttataattttcagttcttttattcctcaaattccgctgttacaataaatcctcttggcgtatgttcgatattttttatgattccatgtgttgacttgattcgttctgaatttttataacatcctgacatggccacagccggttcgataatataactgtaattcatatatgattgaaactccgagatttcaacttcatcaccaatatgaatcagtccctggcgttccattttaaacttttcctgacgcattaaaattcttctttctgtctaattattttaactgaaaaatttataatattttttcatccaatataatcgtaaaaggtccatcattgatcaatgatatcttcatgtctgctccaaaaatcccatgttctacaacaggtactgattttttcgcctcctgaatcatatattcatataattcctccgccatatgtggttcacccgcttcaataaaacttggtctgtttcccttcttgcagtttgcatacagcgtaaattgtgaaaccatcaaaagttctccatttacatcttttaaggacagattagtctttccattttcatcttcaaaaatacgcagtccaagcagtttttttaaatatttatccgccacctctctggaatcttcatgacctgctcccacaaagacaagcaaacctttatttatctttcctaccgtattttcatctacctgtacctctgcctgaagtacacgttgtattacaagacgcattttcttcctcccggatctatatttatatatcaattgtattataccatctacaaccagctaagaaaagccctgtacaggacagctcatttctgtagaactcctgtaacagggcttaaaatatcctgtttattatttggatattttggttctgtcaaaaattttaatggattcaattattgcctcagttgcataatcaataccaagcttaccgctgtctatgcaaagattatagctccgtgcagctccccatttcttattggtatagtaattataataactggctctgctcttgtcagtttttgtaatcatatcttttgcttcttttggagtttttccatgtttggatgcaattctgttgattctccagtcaagatccgcatgcacaaaaatactgaaacaatcattccagtctgccagtgcataatctgcacaacgtcctaccattacacaaggtccctcacctgccagtttcttaattgcatcaaactgtgccagaaaaattttgtgattcattggcatatctgagaatccggatgaagaatatccaaaagaatatgtatccattacaagagaatacagaaaactattggttggtttttcatcatggtgttcaaacagctctttgcagattccgctgtcattggcagcgtgttccagaagttccttatcataacatttaattccgaagtatttagcaacctcctgtccaatctgtcttccgccacttccatattcacgtccgattgtaataattgagcttgtactgttcataatatacactcccttctgcaaaaatcatgttactattatacaatattttcaaaagaattccaactattttctcaatttatccaaaagttttgaaaaatattccggaatcggagcctcaaactccatatattcttcagttaccggatgtataaatccaagaatcattgcatgaagtgcctgtccttgaagatgataaggatttttagaagatccatagaccgtatctccaaggagtggatgtcccagacttgccatatgtacacgaatctgatgcgtacgacctgtttccagacgacattcaatatacgtagtctgaccaaaacgctccaggactttataatgtgtgactgcctcttttccatttttatggttgatcgccatcttcttacgatcgatcggatgacgcccgatcggtgcgtctacagtcccttcatcttctttgatatttccctgaacaattgcgcgatatcgtcttttaatactgtgttccttaagctgttctgcaaggtttctgtgcaccatatcatccttacagatcaaaagagcccccgtagtgtctttatcgatacgatgaacgataccaggacgcataactccattgattccggagagattatctccacaatgtgccattacagcattaaccagcgttccctccatatgtcctgcacttggatgtacgaccatgtctttaggcttatttacaaccataagccattgatcctcatacagaatatccaacggaatgttctccggctttatatccggtgtctgcagatccgggatatttaaaataacatgatctcctggctgtgttttataatttgccttaacaatacgggtattcacagaaaccgctccatctttcagcagcttctgcagataagaacgcgaaagatccggacagcactctgccagatacttatcgattctgacgcttttttctgaagaatctatattaaattctagtttttccataagtcatcctttattttttaataaaatcaaaatcctcatctctgtagtggaaaagaacgagtatcaccaatgcaatgccgccacatacaacatagatatctgcaagattaaatatcggaaaatcgatcaaagaaacataaataaaatctacaacatatcctcgaaatgcccggtcaataaaatttcctgccgcacctcctgtcagaataccacctgccagaatcagtggaatgtaatatcctgttttgggaattctgaagaaaagccacaacattacagcacaaaaagctatgcacagtacaagaaaaagcatctgacgtccctgaagcatgccaaatgccattcctctgttttccagatactgcaactccagcacacccgtaataagcgtcatcccggatgtgccctttaattttgatactgcccagtattttgctgcctgatctgccactatgagtaatataattccagtaaaccacaccaaaaaacagataaaagaagctttctttttattcatcgaagaatctcctgaattccctccagcaattcctgatctgtcacggtacgatcaataaaactgcctccaaggcccttcataagaacaaatttaatctgtccctgttccattttcttgtcctttttagtcgcagcaagaatatctcccgcacgcaatccctcgatgtacgttggaagccgataagactcacagccctgtatgatctgctgatattctttttctgtaagcagtcctctgttcaaagaaatctttgcagctgcaataagcccgatcgcaacacactggccatgcaagagtttaaaatccatgagtttttctactgcatggccaatcgtatgaccaagattaagcaatgcacgttctccctgctcttttggatcacgttctacaacacctgctttgatctcacagcagcgacgaatcattttcttcagaagtgctgtatccaactgctgtattttttcctgctccgcacacacaaactgataaaagtctccgtcgcagataagccctgtcttcaagacttctcccatgccacaggcaaactgttctgccggaagagaacgcaatgtgtgaaggttcatataaacaagacgaggctgatggaaagcacctaccatgtttttatactgctccagatctactccggtcttacctccaacactgctgtccacctgagaaagaagtgttgtaggaacctgaataaaatcgataccgcgaagatatgttgccgcaccaaatcctgcaagatcacctaccacaccgcctccaagcgcaatgatcagactcttacggtccagtttttcctcgatcagtactttataaagctgttgtactgtattcagatttttgcttttttcacctgcttcaaatgtaaacacagatattttggaagctactggtgaaagaactttctgtacctctgccgcataaagcggtgccacattcgtatctgttacaatacaaaaatttctgttctccagtccctctgtccgaattgcgtccgcaagtttctcaaacccatcctcaaaatagatcggatagtaaaaatctccgtttcttctgacctgtaatgcatctgtgcccatatcttagtcctcctgatccttactgataacgcagcagtttcacactgttccgtcctttttttgtctgtctggaaacgccctcataccgaaatcgccccttaccacgtaccgaaataatatctccatcttttggctcatatccattcgatgtaattaattttccatttacaaatacctgaccgccttctatgaaaggaaccatactgtttcttgaagtctgaaaagccagtccaatcagtgcatccagacgtacggaagcacatgtgccattgatctcctgaaattccggctccggtatatgttccggattatccaccatagaaagtttcatagtcgtatggcgtactctggtcagattttctatgatataatctgcaattttttcgtgacagaatatccatgcagtatgtttctgtacaagaatatctcctatcacagcacgctcgattcccaaattgagaactgctcccagaaaatcacgatgcgtcagttcctctgaaaatttcgcagcaagtggttctgccttcaggcatttaataggatacttccatggaaataaaagagcatcaggatgaaatgctaccatctgacgctctgcctgttcgtaaccgccaaaacattccataactacgcctggcatttgatttttacggtcatttatgatattttgttcatttaaattaagaaaatccgaaaaagtgacaatatctctctgataagagagatttgccagttcccggattctcttgataaagaattcgtctttttccattgttaatcaataccctgtgttaatcaatatcctgctcttacagacggtaccggattacttccaagaatattctgaagatcaccagtaatatccacattgtaaggtccaagaatgaagatataactggataccttctgcaggcttccacccagagaataacatgcaccggatgtaaaatcgataatcctctgtgcaagttccatatcaagtccttcaagattcaatacaactgtagaattgtctactaatgtatctgcaatttcacgagtatcttccatcgatgtaggtctgattacacatacttccatatttgctgcctgtgatccctttctgctgcttcgcattggagtgatcttggatgaagtacttcgtaccggcttgtcctgtttgacagatacttttggtatggaaacagttttgactggctgtttcggtgcagctgcaaccggttcttcatcatcaaaatcatcaacctcttcgtcatcagcttttttagagaatttctggaaaaatttctttacaggcttatcctcctgatcatcatccaggaaatcatcgtcatcactgtcaagaagatcatcatctaaataatcatcttcatcataatcatcattaagttttacggcatccaaaagtttatctaaaacgctcattttaatctccaatcctatttgtcttatggctcaatgcgaatagtctcgttcaccgaaaatacccgttccaacccgaaccatcgtagcgccctcctgcacggcaacctgataatctccggtcatacccatgctcaaaacactcatattaacattattaatgtttttggctgcaatgtcaacacttaatttcttcaattggcggaaaatcccacgattctcttccggatcttcgacatatggagcaatcgtcatcaggccctttatatttatatgcggcaatgctgccacagattccacaagcgaaagaacttcttctgttttcaggccgaatttactctcctcctgtgctacatttacttcaataagtatcggaactgtcacattatgttttgcagcttcattttcaattgtttctgcaagtctcagagaatctacagaatgaatcagtgcaaccttgtctacaatatattttactttatttctctgcagatgtccgatcatatgccagcgaatatctgacgggagctgtggatatttatccatgatctcctgaaccttattttctccaaagtctcttgaacctgcatcatacgcttcctgaagcatagacaccggtttcgtcttacttacagaaatcaacgtcacttctcccggatcacgatttactgccctgcatgcttcctcaatgtttttgcgaacctgttcaagattttctgttatcataatttataagcctcctgattcgtataaaattctttattaatcattttaccttttaatataaaatttcttcctcatctactttatcagcatttcgtacaatatgatcatacctcgccagaccatatgctgtattttttgaaacgatcgcatattcttcattctgatccagtatctctattctgcgaaatacggcatacccctggttgatacaatatacaccctcaagtacaccgacatcactgactacatagcggctctgatctttctggctgatgatcacgtcaccttctttaaatgacttctgatcaacataatacagatattttttcttactttcatcctctgtatcctggcttccatcctctatgcttgcataaatagacggatttacaaatgtacgtgtctcgtttccgcttttatctttgccaaggaccatgaaacctgtttcctgactgtcttcatttgttgtcgcataatcagaaggtatcaggtaaaattcctttgtaacaattgatgacaatggaattttcaatccagtgactgtatttgttacaagttctatttccaggaaacgatctgaggcatagcgaatcacacccttgttaaaatcaatcttgccatacttagctccatcaatctcaacaatactgaaatctccactctgagtcatatcatctttcagaaatttcacacgcacaaccgtacggtcagcgagctttgccgcctgcttctcactcaacggaatcatcaggctccagttctcatccgaaaccaacgtataaagactgtccccagctgaaacagcatcgtgtgtcttaagatctgtttcatgataagaattctggtcaaagtcttctgccgtaagggtatccgctgttttattttcgtatccatctgtcgaatacaaaataattccatcctgttctgctttgctgagtgtctgccctccatagcttacaaccccggaatccgatgaagtaccacttacccctgcatactgtaagatacttccctcaagattatatttaaagctgtatgtattattaaatttgctcgggttatatccctttgaaaagctcaacatctgactgcgaattgcagaaagatcatctgaactcagttcagcagacgattctgtcttctgtgaactgctgataccatataccacgccgttggcattaatcttgctaccttcccgggcataataactgacatatccccctgtctctgccttatatactttctctgtccgtatcgcaagtcccgtataggtttcatttctggaaagaggtccggcaatgaccagatatgattcaatgttggaagatgtcagatacaaaacaacgctgaacagcatatagagaaacagagctccaaacagcattgtaccaatattcaaccccaacacacttttgatcttctttaatattcctgcattatctgcaaaatgtttatccttatcaggcaaaaaaatgcctcctttattcttttaactaaattacatactaaggtattgtaccattttcaccttcatctgacaagaaaaaggggaaattattcagtgcgaacatattttccgaatatttgtttgctattacgaaaaaggtatgttatactttttattaatcagaatgatcgtgaatcaggaggtattttctatggcatacggcagaatcagcaagaaacagcaggagattctggattatataaaaaatgagattcttaacagaggatttcccccagcagtcagggagatttgtgaggcagttaatctgaagtctacttcttctgttcactctcacctggaagctctcgaaaaaaacggttatatacgcagagatgccacgaaaccacgtgcaattgaaatcattgatgataattttaaccttgtccgcagagaagttgtaaatgtacctctggtaggaaccgttgcagccggtcagcctatgcttgccgttgaaaacatcgaaggatattttccggttcctgcagaatatatgccaaatgcgcagagcttcatgcttaaagtaaaaggtgacagcatgatcaatgccggcatctttgacggtgatcaggttctggtcagacaacagagttctgcttctaacggagatattgtagttgcactggtagaagattctgccacagttaagactttttacaaagaagacggttattatcgcctgcagccggagaatgattcaatggaaccgattcttgtacatgataatctcaaaattcttggtaaagtatttggtgtttttcgtttatacgaataaaaaacaggagtatatcagattattttccgatatactcctgtttttcaccatctatggtttacatattttttttacagttaacttatttcaaaaattctgaaacatccagttcttttccatctctccagattctttcaagatcgtaaaaaagacgattttcttcatcaaacacatgaataataagatcaccataatccataagaatccagtttgaatttcttgttccttcaatctgttttggttcaaatccagctcttccaagctgttcctcaacattatctacaattgcctgcacctggttcagattgcttccgcttgtaatcacaaaataatccgcgatcacagaaacctctcggatatcaattacctttatgtccagtgcttttttatcatcaattgctttgcaggcaatgcttaccatttcctgttctctgttcataaacatgtttcctttccggatcaggcctgttttcgaattttcagcctgtcctcatgtagcattgtataataagcatacgcatctttagttgctgaatctacatcatttggattttcatccagataagacaacgtatctttcagaatctgatacatacactcatccagatcttcaaatgccagtctgcggatttctgtaagccttggtgctttatttcgtgccggctcgatataatctgcaatataaacaattttttccagcatagtcatatccggtttacctgttgtatgatatgtgattgcagaaagaatctccttatctgtgacattatattttgcctttgcaatatatgcccccagtttagcatgaagaagaaacggatgttctttttcaaaatcactgaccggaatatggtgttctgcacatatctttaacttttttttatttggaatacattttgcactgtcatgaagcaggccggccacctgagcatttttcaggtcatatccgtgtaccatcgcaagagaagcacaggtaaacataactcctaaagtatgttcatagcggttttcatcaagatatttggcaagttttttttgcatttttatgaaatcgtaatcagacattgttgtggccaactccctctgttatgtgataaatgtgatttttatctatataatcagctactgcatctggcacataataccggagactcttaccctcctgatgccacttgcgcagcagttgacttgaaatatctatattcagtgtattcaggctgataaatcggccattataccgttcagacaaatatgtcatctgttcattaagtttctcaaccggcacatgatcacgtactgctacaacaatcgtacaggctttacatattcttgccggctctctccatgaggaaaaatcgtacagagaatccgctccgataataaaataataatcggtgtccggattttgttctttcagtgtttccagtgtatggtaggtatatgtgaatcctttatcattcatttcggtcaatgaaagttcaaaatgtggatttccggaaattgctttttctaccatagatactctctgagcatctgtggcccgtccaatccggttctgtttatgaggaggatttccggccggcataaataatatcttatccaggccaagctgttcatatgttttctcccccagtatcagatgaccgatgtggatcggatcaaatgttcctcccataataccaatttttttacgtctggtttccattgttctctgtactccttctcgtattacggaagaatgatttttttcttgttgtcttttccttcacggtaaagaacgatttttcttccaatcacctgaacaacctgtgaatgtgttctctctgccagaacttctgccatctgacgcggatcatccaggcaattttgaagtacactgattttgatcagttcacgtgctgcaagtgcctcatcaacagccgctgtattttccggtgtgacagaacccttaccaagctgcatgatcggttccattttcattgcaagacctttcaggtatgctctctgtttgcttgtcatagtttcagacctttctatttataataatcaaagtcaaatccgtacatacggacagtatttccctcttcaatacctgctttttccagttcctccaggataccgccttctttcaggaaacgctggaagaaagcaaagcctttttcagaatccagattggtatatccaagcattttttcaatcttaggtccttccacaacaaagatatccggatcttcaggatgtctctcaactgtaaacggaagattttcggtaaataattcatcctctgggaagaattcctgttcaaatacgatacgctctgccggaacactgtccagaagttccttgattccgtagagaagttctttcagtccctgacctgttactgccgaaattggataaaccttgattccctttggttcaaactctgccttaagacggtcaataggattctcctcaccgtcatcaaaaatacaatcgatcttatttgcagcaatcagctgaggtcttgccgcaatgtccggattatatgcttccagttctttgttgatcttatgaatatcgtctaccggatcacgtccttcggtagaggctgcatccacaatatgaacaagaacacgggtacgttcgatatgtctcaggaattcatggcccagaccaactccctcggatgcaccttcgatcagtcccggaatatcagcaataacaaagccaccatttgctgtatccactacaccgaggttcggacttaatgttgtaaagtggtaattggcaattttcggctgggcatttgttactctggaaaggaatgtggattttccaacatttggaaaaccaacaagtccaacatctgcgatcactttcagctccagaaggacttccagctcctgcgccggctggcccggctgtgcaaatttaggaacctgcatggtaggagttgcataatgctggtttccttttccaccacgtccgcccttcaaaacgatctgacggcggttctctccggacatatctgcaatcaccttgcgtgactgtgcttccataattacagttccttccgggactttcagaacaatgtcatcaccatcagctccatggcagcgttttttcccgccttcctgaccgtcctgtgctttaaatttgtgtttatggcgatactcgccaagcgtattctgaccttcatccacttcaaagatcacatctccgcctcttccgccgtctccgccgtcaggaccgccattcggtacatacagctctcggcggaagcttacatgtccatctccgccctttcctgaacggatgatgatttttgctctgtctgcaaacatatgtcgctcctttttattttaaatctaaagaaaggctccaaacctgaacgatttgaagcctcacgctgaacttgattattctgcctctacaggaacgatagaaacctgtttcttatcgcgtccttttctggtgaatcttactacaccatctgtcagtgcaaataatgtataatctttaccacagcctacattttcacctgggtgaatctttgttccacgctgtctgtaaaggatgtttccagctttaacaaactgtccgtctgctcttttggcacctaatctcttggattcggagtcacggccgttctttgtagaaccaacaccttttttatgtgcgaataactgaaggttcattttcatcatgtcgttacacctccctgacttttacttttaaataacgtttagaataactattctcaatttctgtcagtccgagaacaagagaatccatcaaaagagttccctcttttgtaacaggtttcacgaaagagaaagaaacaaatccatcactctcttctgcctgaatctgatctcctgtcagctgttccagggaattcaccgtattgattatcagagcagagacagcggcacatataatgtcgtatccctcttctgcatatccggcatgccctttggatgtaaaactgacatatgaattgttcttcttactgactgtcactgtaatcatgcaaacaccagattaagcgttgatcttttcgattttaacttttgtaaactgctgtctgtgaccgtttttcttgtgatatccagtttttcttttgtatttgtaaacgataacttttttagcttttccgttttcaactacagaagcggtaacactggcattagctacgtcagctccaacttttaaaccttcattgctaactgcaagaacgttatcaaaagtaacggtttcaccagcttcaacaccgagcttttcaactctgattacgtcgccctcggcaactttgtactgtttaccacctgttgcaataattgcgtacatctgtggcacctcctataaactttactcgccagatatggtggaatgagttccaactcatgctcttaaacctctctgtgcggcatctgctatatagtagcatggttttttgtactcgtcaagagaaataaaatattttttaaaaattttatatgttttatgaaggtttccctgcaaaaagggatcctgtcccccaacagaatcccttgattgccccatcttatgtaattcttgtccaaattagtccaaaaagactgatcccagattcttttttactttttataaagcagttacgatcttatcctgtaaggattccggaatctcttctttatccagggacatactaacgacaaatttaacattaaatttctcacctacagcattcagctgctccagtgtacctgtaacgtctttgccttccagtttggccgttgtaagaaaactgtcaagataaacctgctcaaggtcatgatcctgtgaaataataccacatacaaatccaacaaactcatctgcattcttaatcggatatacagatacatcgatcagacgaactttgttgttcagttcatacatatgttttgtgcttttgtctaagtaaacaatgctgccatttgcctctttaattgcgccgttcactttgtctaacagtacttttgttttgcctttgcctttctttcctacgatcagttcaaccatgctgttttcctccttagacacaatatataatttttgaataaaaacgatgttgaatatggttaatattatagtgcaacttgttttaaaattcaagagtaatttggatttttttgtcactttttccaaacagtctgaacattctcgcttatactgtgtttatattttcaaggagggatgtcatctgctgataaagaagttcttttgtagaagcacccataacaattgaaacatatggttccccatatgaattctgacagagcaatgccagacagtttcctgcgttgcttgtcgttccggtctttccgccaagaaccgttactccttttggagcatttgcctcacctgtcagataatgatccgtcgcagtaagtgacacactatcttcagagccgtcactgtgctggaatgtaactgtataactcggaagctgtgtaatttccgtgaattccggatatttcaatgcttctttcaacatgagatagatatcgtacggtgttgtataatgattttcgtcctgcagaccatgtggatttgtaaaatgtgttcctgtacatccaagctgcgctgcatattcattcatcattgcaacaaagttttctgtagagccacccacatgagtcgcaatcgcagatgccgcatcatttccggaataaaccagaaggcagtgcacaagctgatccatcgtcacctgatcacccacctgaaaaccaactacctgtgatccttcctcaagagtgatattttcctgtgtgatcgttacaacatcatccatattactgtttttgaaagcaagaagcgcagttataattttcgtaatacttgcaggataaactttatcataggctcccttggcatataaaacggatttatctttaagatccaacagaactcccttctgagcctgttccagcgaaacagaatccagtgtctgatcaccagtcaccacacaaagatcagctgcaaatgcatctgctctctgacttattcctgaaatcttctgatgctgaaactctctgtctgtactgtaagccattaccggttcggaacctattccgccccgcagcatataaaacagtcctcctgcaccacataccagaatcagcagcaatgcaatcagaagaattgtatttttcattctctttttacgcatacgccgcattctcgctgaactttttgatgaacgtttctgtggatgctgtcgggaagcatgcatctgttccggacgtgccgaccttctctgctgacctgcagatgttttacctttttgttgttttgtcataaatagtcctctttctggtcaattgcttttcttcggatttctttattgtatgcgctgctttgaagtccgacattcaataccatacccattccgatataaagactgatcagtgacgtaagtccataactgacaaatggaagcggtgtaccggtatttggcgcgattcccgtagccacgcatatattcaggaagctctgcaatgatatgatacttgccataccacaacatatgatctttccggacaagtcttttgcccgcaggctcatccggatacattccacagaaatcgccagtaacaggattacaatactacagcatcccataaatccgtattcctcaccggctaccgcaaaaataaagtctgtctgattctcagacacaaaattaccatcatttacagatgcaacttctttatcaccagacagtttttttcctatcagttctcccgaagcaattgctgttttggagttattttgctgttcaatatcatcactgtactcttcattctcaggatacagaaatgccatgatacgttttctctgatagtctttgatcagtttctgatccggctgtaccacgatcgatacaaaaataattgccaatggaataatgatcagaaacattcctccgatgatcttataactgagccctgcaatataaatcaggatgcaaaatacagccagaagcataagtgtgtttttcatatccggctgttcataaatcagaaacagcggaattgccagaagaatcactgattttgccagtgttttgaatgtattcagatcttcttcatgatccataaagaacctggcaaaaaatagtatgataataattttcgacagctccgtcggctgaaaacggataaatccaaaatcaatccaacgtgccgcaccattggcagaatcaccaaaaagtcgtacgatcagcaaaagcacaatatttgcgccatacatgatccactggaaatttgaaatccaggaataatccatcaatgacagaataaccataatgatcagaccgagaatcacacccacaagctgtttggatttcagatcttccctcgcacttcccacaagaacgattccgatcacactgatcgccagaagaaaaattaccagtctgaaattataaaatcgtaatttatactgttttaacattttgtcctttgttcctttttggagcatacgggtatcttcgcatggataaccggtggttcctgtgtgatctgcacagtcacctgtttttcatctatggagatatatttttttaccgtatgaatcaaatcatttttcaacatgcttatcatttgcggagagcagtcgatacgttcggataccagtagaagttttattctgtttctggcatattccgcagaccgaccttttatctgactaaaagatttcactgaaatcccctcctttaacagaaaaaatcctgttatttatgaaaaatctcacttaatcttttcagcatgcctttcttttgctgcagttccacaaacggaacttcctcaccaagaaggcgccggcagatattacggtactcttcttctgcctgcgatttctgaccggaaaggggttcaccctgattggccgcaatcacaatctgctcatcatccagaatcgtaccaaggagatttaccgcaagaatttccgtcacatcatccactgacatcatatcgcccctggcaatcatatccggtcgcaggcgattgatgatcagatgaatatctctcaaatcagaagcttcaagaagccctatgatacgatccgcatcgcgaattgcagaaacttccggagttgtgacaacgattgccttatcagctccggcaatcgcattgcggaacccctgttcaattcccgcagggcaatccagcaatacataatcgaattcttctctgagctcatctgtgagtttgatcatctgctcaggagacactgccgatttatctttggtctgtgccgaaggcagaagaaaaagatccggataacgtctgtccttgatcaatgcctgtttcattctgcagcttccattgataacatccaccagattatacacaatccggttctccaggccaaggatcacatccagattacgaaggcctatatccgtatccactacaactgtttttttgttaagcatcgcaagtcccgttccgatattggcaactgtggttgttttacccacacccccttttccggatgttactacaatgacttctcccattttattttcctcctcatagatatttccagacttctggtattctcttatgtggttttgctatacagcagccagagactgctgtatatggttagtcgttcgaggtattactggtatcactggaggcatagccagtcagaatggtatcttcatctgccagattataaatgtatttcagaatatcatttgctgtcaggcatgcatttcccgaagcgtatccatttgcaattcgcactgcaatagaatactccggctcagatgtatctgaagatgtcgtatatccaatgaaaaggccatggttcgggtgataaatatccagctcggcggtacctgtttttcctgaaagtgtaactcccagtccattaaactgctcatgagtcagaaccacccgtcgcataccttcatgaatatcattccatacattatccggaacatcactcatctgatttacaacagatgaaccgtattccttcaatgtcttaccctgtgaatcagtaactttatccagaagtgaaagatcatagactgttccagatgtagcaagtgctgtcgcataacgtgccagttgactggttgtaaacaaatgattaccctgtccaatgtaagaaggaaccgctttgctgtccgaaacatgcggacttgcctctgaaatctctattccggttttcttatcaaggttaaattccgaagcatatttctgcagcttggtaaggctgagattttctgagaaatctccatctgaatttttacctgcaaggaaaccaaccatattgaagaaatagttacaggattgttcaatcgctccggttatctccagcgatccatgtccctgcttgttccaacagaaaatcgacggagttacaagatcaaattcaccggtacaatcaaaataagtatcatcattgatcacgccttccatcataccggtaaccgccgaaagaagcttcagcgtagaaccaggtgctgtcgtctgctgtgttgccttattaaagaaaggactggacttgtccaatgcaagcttcgtataatagctggtatccatattattgctaagacgattattgtcatatcccggataggatacacaggcaagtacctttcctgtttttgcatcggtaatgactgccgatgcagaacaaggtgcaagtgccagctgtgccggttcaatttccagattggaaatcttattgatcataaaatcgtaagcagacatggcacccgatgcaagacttgcataacaatcatcttcttttgacagtactccctgctcataaaggaccagacagatatcctgtcctgtaatctgatcattcatgagaagatatttataaagaagttttgaaaatcctgtatctgttttcaggtaatctgtaatataggaagtcagtgcctgatatatttcttctgaatcaagatactctccctttggagaaatgacagaaatatcgatccagttctgactggctgcataattcagataatccttcagactaatgctctgatcatttgcccaggcctgataagtggcatctgatgtatccacctcattcttatcgatcacaccaagcgtatcccggagcactgtatcgcaaatatatgtaagatactcctgcacctcagtactttcgtctttgtaagccggcggatcagaacttgtaagcctgttagttattgtatcaaaaacttcctgctgcttttgttgaaatttggcataaagatttttttctgtatccgaagcttcttctctgctgaatttatcaatatcgatgacgctgtttgctatcagtgcattatatacatcataaatcggaatgatgatcctacttgcatcattttcgcctttataatcgtattctttcacagcttcaatcttattcagaagaataccagccacacgctgtttcaggatctgataaatcgcactctgccagtctgcatctactgaaagataaacatcatttccggcaaccggttctactgttgtgttatcatcgattttcagtacttttccaagattatcaacggttaccgtttcctgaccatcttttccctgaagttccagctccatatactgttcaataccggctttacctacaattgcatcattggaataatccggattttctttcttaagactttccaactcttctgatgatgcccgtccggtataaccgagaagcggtcccatgctctcgtcatcaacatactgacgtacagaatcctccagaacatcgattccctggagttcattctggttttccataactgctgcaactgtactttcactaacgttcgttgcaatcgtaaccgccatatatttctggaagctgttcgtactcagctcataccgcatgattgcaatatcaagaacttcctgtttggtaagttccttcggaagcccatatttttttaattcttcatctgtataagcatcgtctccataaagtacgatagaaaatcccttatttccactgagataagcaaccatatcttctgccgttgccgccgcctcatcttctgtcaggtcatcgatcagtgcatgtccatagatatccgccttaaaacgactcagtgtaaatccttcctttacgtcaaacgcatagtttccatccttatccagcttaatatggaaagaattcgacagctgatcgccgttttctgcaagaatcttcagaactttataagccaccccgttcagcgtcagatttttctgccgggtactgtcataagttccattatcctcaaacgtaagagaataagataacacattcgatgcgatcagcttattgtttttgtcatatatatttcctcttgtactcttaagcacacgcgttttcgttgttcgtgtctgaaattcatttatatagttctcaccctggatgatctgcaggtcaaacagctgtctcacaagaacaaacgccatgagaataaatacaagtaacagtactgttgttctctttaactgaatttttttgatgattttttttattttaatacccaaatagactcactttctttcctggttggactcataaaatgataattaatataatgaaatactctgtatacgatcattgtcagaaaaacagtataaaaaatttccggaacaataatacgggtaaaatatacccccagacccagtctgcccctcagcaggaactgaagtgcataaaccgccagattatacagaaaatccataatcgcagtcagcagcatcggtacttttatatcatcatcataataaatacgaaatgcataaccgctcaggaatcccgcatacatatagatcagtgcataaaacccaaaaacggatccataaaacagatccacaagcagaccacagaaaaagcctgtccacaatccgctcttacgtccacgcataagccccatagatacgcaaagaatcagtaacaggttcggtgtgatcgagccaatagagatcagatgcagcactgttgactgcatcagaaaacagacaatgatcgtaaaaaacagaacgatcttacttttcattcctcggccccttcctctgtggaatctttcttgttgacagtaattacaaatacatccttcaagtgctgaaaatctacaggtgtaacgattgttcctgattttgtcagattgttggtatctaattgaatatcgctgacatatccgataaacagaccttctacgtatttttcactgatatttgaagtaacaacctgctcacctactgttactttatcttctttgtcatacagctgtgtaaaacgcagtttcccttcatcgatcaactccaggtcaccttccaccacacaattgtcatctgtaccgactgtcatggcactgacattactactgtcatcaataatggaacgaacagttgcccagttactgcccacctcggtaacaatgccgacaagtcccttgcctgcaattacattgttatctacacggatgccgtctttgcttcctttattgatcatgaatgtatcataccagttacccggatctttggatataattctggctgcgaccttcggataatccgaatattccgcatccagatcatagagttcctgcagtctggaaagctcggactgattctgaataagaatattgttctgttctgttaaagtatctacagtatttttcagttcctcattctgatctataagatcctgtttttcctgaaaagatttattgatatcagtaagccagagtccgattgttgtgatacttttttcaaaaggaacaacgatcattcctgccgcttcctgaagcggagctgatgtaatcccggaggcaagtgtggcaaccacagcacttccacagaaaaatgtcatgatcacaagaagatgtttactttttaaatgtattcgaaatcgaaacttctttttcaggtttttcatgtattatcatacccctaaagaattataattgtgtctttataatttgcgttgtttgacaggctgcgcccatttcatcagttcatggtcacggatgattttttccagtcctgcaactgtcgctttttcatataatggagataagttaaaagatacccccgtataactcgcaagataattatctatgtaaggaatcttggtacttcccccggcaaggtagattccttctcttgaaatatggtaagaaatctgcggtggaattctttccaaaaaagttttcatttctgccgcaatctcatttacgcagttcataattccggcatttaccacatatccggatatgatctcttctctcggcagtcctgatattccatcaattccaaccaccttgcgtgcttctctgcgctgatcattgagccgtcccatggctatcttcaggcgttttccggtacgcgtgccaatctgcagattgtaacgtttcctgatctcactgcagatagcttcattcatctgacgtccaccgatcggaatttttttcgcaatgatgatttttccatccgtgatgattgagaactgtgtactctgtgctccaatatttacgatcatacttccagcatttcggtttaggtccacacccatggcaattgcgtctgcaattggagcctctaccatatatacccggttctgcctgagccaatggccatttgctacatggtaatatgcccgtttctctactgcagtcatatccagcggaacagaaaaaaacatatctgatccaattcccagaaaatgatcaatctttttcatcatactgtacaacgcaatctcctgcagttcaagattggctatcataccaaaagccatcggcgaattcaccacgatattggcaggagccttttcaaacatatcgtatgcttcattgcccacggcgatgatcctgcgcccttttgacgctatcatgttcttttccatataacttttgtttttaaaaaacgaataaaccttgatactgctgcttccaagatctattccatatgtttttcttaaaagcataaaaatttcccttcattccggatacgctcccatcagtccctcttcccggaaactgatatatctgtgatcgcctatgatgatatgatcaagcagattaattcccagcatttcgccggcctgacagattcgttcagtaatttctttatcacatttactgggagccggatttcctcccggatgattatgaatcagtatcagattgaccgcatggtatcgaagtgcttccagatatacttcccgcggtgtgatcagcgttgcatttacggttccttttgacagcatggtatctccaagcagatgattctgattatccagcatcatgcagatcataatctcctgttcctgatgtcgcagctgttccatataatatgctgcaatagaatccggactgttaaagtcaagcgaaatccttgcagccgtactggcaatccttttggataattctccgatgcacttcagctgaactgccttgaccgttcctatcccatgtatctttttcagatctgatactgaacagtgaagcagtcccagaagtcccggatagggtgactgctccatatgacttaaaatatcgtttgccagggtcagagaattcattcctctggtaccacaccggagtatcactgcaaggagctcaccgtcacttaaagtgctctcaccctctcgaatacatttctcataaggccgctgtgattccggtatttctttcatagtatggttcattttgtttacctgtcgctctctgtgacagaacccaaaagaatcagaaattattttagcataaaaagagggagatgtacactccctcctaaaaatttctaaatttttcacatataaactcagccgttttgataccatccatagcagctgacgtgatgcctcctgcataccctgcaccttccccgcacggatatattccctctatattagaatatccctcacggtttcgtacgattcttaccggcgaagaagtacggctctccacgccactcagaatcgcgtcgttccggtcaaatcccttcagtttctttccaaatgcaagaactccttcttcaatcgaatcaccgatttctttcggcaggattgagcgtacatcagcaaatacatgagcacctttcatctgaggttcgatttctccaaatgcagaactcttctgatgtaacttgtaatcgccaaataactgaaccggaatttttccttttccaatttcccatgctctcttttccagctctctctgaaatgaaatccctccaagtggaccttcctccgggaaatcctctggtgtgaccgttacgatcagtgcactgtttgcatttttactgtcacgcgcctgataactcattccattgactgccagcattccctgttcagaggatgcgttaaccacataaccgcccggacacatgcagaatgaataaacgcctctgccattttcacaggtatgtgtcactttataacttgcagctcccagaaattcattttcctcttctccataaagatcgtaattgatcattttctgtggatgttccatacgaagtccgaccgcaaaagatttcggttccatataaacaccacgtctgtgaagcatatcaaacgtatcccgggcactatgtcccagcgcaagcacacaggcatctgccggtatcttttcttcattattgacttcaactgcagtcagatgaccgttttcgatgcaaagatctgtcacctttgtttcaaagcgaaaagaacctcccatctcttcaatctgatgacgcatcgtttcaacaatgccaatcagtacatctgttccaagatgcggtttctgttgataaacgatttcctccggtgcgcctgcctctacaaaacgtttcagaacctcatggttacgtccattcggatcttttaccagtgtgttaagctttccatctgaaaaggttccggcaccgccttccccgaactgcacgttggaatccggatccagcactccatctttccagaagcaatctaccgtttctttacgtttctgcgcctcctgaccgcgttccagaaccagtggacgataaccggctcttgccagataccaggcgcagaaaagtcctgccggtccacttccaacaataaccggcacatgctccagtttctctgttcccggcaaaggaaactgataattctttttattgattgacataatattattattgtgaactcttcgcaaaattttttgttcagcagctgttttcacatctactgtatagacaaattttttgtcatccttatgtcttgcatccagagactggcggacaatctcataggaaaatgtatctcccgcacatttaagtgtctttgcaattttcttcttcagctgttccggagtgtgctccaccggaagcttcaactgtgtaattcgtatcataaattctcctttgcgctgctgcgccctgccacaacaccgcttgaccatgcccattgaagattataacctccacagggaccatctatatccaacagctctccggcaaaataaagtcccttatgcaatacggactccagtgtttccggattgacctgtgaagtatccacccctccggagcagacctgtgcctgttcaaatccggaactgtcctttacttccagctcatatgacgtaatcgtgtcacaaagatcttttttctgttttcggaacattttaatcagtttatcaggcagcagtcccaagagcagctctgcagctgactgatatggacagatttcctgcctttttttcaaatattcctttaaagaagcttttgtatattccggaagaaagttcacagacagcgttactttttttccttcatccagtgcacggattgcatagctgctcaactgaaacaccggtatgccggaaattccataatccgtcagctgtacttccccactctcttctacaaatctctttccatcaatcaataatgtaacttttgcgtccgtacgaacacctgcccatgcagaaaaaacatttcccttacatcgaagtcctgtaagtgcaggcagggggcggataatatgatgtccgagatttgctgcaagctcatagccgctgccatccgaacctgggacctgtgaagctttagaaccattggcaaggatcaccttatctccttcataagtccacccggaggtctgtactttccagcgcccattctcccatgaaacagattctgcatgttcccttgttttgattttgacctttaaagctcttgctttcaatatcaagagttccggaatacatttcgcctgattgcttctgggatacagccatccattacgttctgtaaaagccaccccaagtttttcaaaaaaagcaagtgtatcctccagcgtaaactgtgccagaatttcttccacaaattccggatgctggcctctgaaaatatcgggacgcatgtctctgttcgtaagattacatctgccattccctgtcacacagattttccggcccggattctcattctgttcaaggagcgtaactgccgcaccattctctgccgctgcaattgcagctgccagtccggaagcacctccccctacaacgatcacctgtgttttttcacccatatcgtctccttcatctgctgccgactgcaacaattcttccttctatctttacggaagtgtcacaatattcgcatctaccagtttctgcaaagacatcagtacgcccagttttgcatgttcccaagtaagtccaccctggaaatacacggcatacggcggcttcaccggaccatctgccgaaagttcaatagatgagccctgtacaaaagcacccgccgccatgataacctggctgtcatatcccggcatgtcccacggttccggatccacataactgtccaccggcgccgctgcctggattcccttacaaaatgcgatcagcccctccggagttccaagtgtcacagcctgaataatgtcctgacgtggctcgctgccattcggaacaacagaaaaaccaagtttttcataaatatttgctgcaaacactgcacctttcagtgcaccttttgtcaccattggtgcaaggaaaaagccctgatagaacgaacggtttacaccaagggaggcaccgacctccatgccaagtcccggacatgtcatacgcgttgccgcattttcaacacattccttcgtacccgcaatataaccgccaatcggtgcaagtccgccacccggattcttgatcagagatccgacgatcatatctgctccgacatcacttggttctatcgtatctacaaactctccgtaacagttatccaccatacagataacgtccggtttgatgctcttgacaaatgcgatcagttctccaatctgttttacagaataggaaggtctggtctgatatcccttagaacgctgaatctcaacaagtttcgttttttcattgattgccgcacgaatcgcatcataatcaaaggttccgtcttctttgagatctacctgtctgtaagttactccatattctgccagagagcctctggacgggcggataccaattacttcttcaagtgtatcgtatggctttcctgccggtgcaagaagctcatctcccgggcgaagatttccaaataaagcaattgccagtgcatgagttccgcaggtgatctgggaacgaatcagacatgcctccgtatgaaaagtatctgcatatactttttccagagtatctcgtccaaaatcatcatagccgtagcctgatgatgactggaaacattctgcacttactttgtttttctgcatggccatcagtactttaagctggttatattccgcagtcttgtcaaactgttcaaatcgttccttcagagatgtttcgatctctgctccaaaatcatagactttggatgagattccaagctgttcatataattccttcatggttattttatgatcctttccaattgtatctgatttattgcgtcttctaactgactatcccaaaatatcatgttctttaagaacactcagcatatattccagaatttctttttcatcccaatgaaatttgtctttatcaacccagatcacatccgactcccgtcgaaaccaggtcagctgccgctttgcaaaatgtctggtatctcgtttcaggatacgtaccgcctcttccagtggatattccccctccagataagccaggatttccttatatcccagtccctgcatggataccataccacgatggcagccctcacgtttcagtccttccacctcttttaccagtccctcttccagcatctggtccactcgtttgtctatccgctcatagaggatatctcttggcgcatttaaaacaaaatatgccagattatacggacttgtctgttttttctgttctgcattatgtgcagatataggcgtaccattctgatgataaaattccagtgcacggatcacacgttttacattgtttgcatggattgtatccgcacttgccggatctacttctttcagcctatcatgaagatactcagcaccttctgtttccgccagtttttccagctctgcacggtaagtgttttcctgctgcgcctctgtaaaatcaatatctctggttaccgcctgaatataaaatccggttcctccgaccagaatcggtatctttcctttttcatagatttcctccatagcttcttttgccatctgctggaattttacgatatgaaattcttcttccggttccagaatatccaccagataatgcattactccctgcatttcctccggacggatcttcgcagaaccgatatccatttttttatatacctgcatggaatctgcagaaataatctcaccgtttaccgcctttgccaatgaaatagaaagacttgttttgccaactgctgtcggcccggtaagaacgatcaaaggtcttttcataatcactcctgtataattcttacacgattcgtttaaactttttttccagttctgttcttgtcattgcaatgatcgtcgggcgtccatgcggacaatgatacggattttccagagtcagaagttcatcgatcagtttttctgcctcctgctgcgacatagcatgatttcccttaactgccgctttgcatgccatcgttgcaagtcttgcagcaaaaatatccaatgtatctttactgttatcagatgccagattatccaacatttccagaaacaattcttcctctgtcagtccatacagattcgatggcaccgcactgatacggtattctctgccaccgaaattctcgatttcaaaaccaaactgttcaaaataattcatatttgctttcagtacttcttcctcctgcatgctcagtgtcacgatcaacggagggttcagatactgtgaatcaatcgaatgttcccggaactgttttaccatacgctcataatataccttttcgtgtgcagcatgctgatcgattatataaaaattgtcctcaaactgtaccagccagtacgtatcaaagatctgtccgatcaggtcaatccggcttctggattctggcgcaagcagtttctcctcaaagagttccagctgctgtggtggagtctgtttttcagtctctctcgatactgcttcctgtatttttagttcttctgcttccgttttctgcacatagtcttgttcataatcttgtacagacttctgtacaattttctgtttaacctgtgtatcaaccttctcaggcacagtatttgttttcttcgaagaattctgaaatgactctggcactgtctgcctctctgtcagtttcttcacttcgtccagtttctgattctcgcgcagtgtaccactgaacatttcttcttcatcttttgaaaatgccggacgataagatgctgccggctctcgtacaacagaatggactggtttttgtgctccgtacagttcttcacgacgtttctgctcaaatggttccggtacagctgcacgcgtaactttttcttctttatcctctttaacagaagaactgtctacagatactttcggaatcatttctcttctggtcagggctgcacgtacagtatcataaactgcatcgtaaacttcctgttctctcgcaaatcgtacctctctttttgccgggtgcacattaacatccagatcgttcccctccatttccatacgaagagaaacaaatggaaatttatgctgcatcaggaaacccctgtaagcattttcgattgcttttgtaataatattatttttaacatatcgtccattgatataatagttctcaaaagaacgattgcctctggcaatttccggtttaccaacaaatccctcaattttcataaaggaattttcctgtgatacctccagaagtgctctggcgatctctctgccatacacgctgtaaataacatccttcacgctgtagttcccggatgtatgcagtttcacctgcttattctgaatatatttaaaagaaatctccggatgggacagtgcaagctgctccatcagcgtatgaatataattcgcctcagtcatatccgacttcaggaacttgcttctcgccggtgtgttataaaaaaggttccgaacaagaaatgtagttccctccggtgctcccagttcttccaatgaatgctcctgtccaccttcgatcacataacgggagccgctgacagaagacggagtttttgtgatcagttctacctgagaaacagcagcgatactggaaagtgcctcaccacgaaatccaagagaagcaatatgttccagatcttccaccttttcaatcttacttgttgcatgacggagaaatgcaagcggaatctgctctgcttccattcctgatccattatccgtaattcggatcagtttcttaccaccatctgtaatttctactgttaccgcagttgctcctgcgtctatcgcattttccacaagctcttttacgacagaagaaggtctttctacaacctctccggctgcaatcttatcaattgtgttctggtctaaaactgcaatttttctcaaagcaacctcccattaccaaaccacgttttatcatttttaccagcggtttttaatcttgttctgcaaattatacaaaatattcatagcttccatcggtgtcaaatgggtcatatccagatcacggatctcgtccacgatatcattgtcctgtaccgtatcaaaaagagacatctgagccatatccacctgatcataaacaattttctgttttttcttcggagccgtcagatccttgactgcagccgtgatatctgcatcactgagttcttctaccagttcctttgcacgattaataacggaatccggcacaccggcaagcttggcaacctgaataccataactcttgtctgcaccgcccttgacgatcttacgaagaaatacaatatcatcgcctttttctttaaccgcgatacaataattattgactcccggaatcttaccttccaattctgtaagttcatgataatgtgtggcaaataaagtctttgcaccacagagtttcgtattactgatatgttcgatcacggaccatgcaattgcaagtccgtcaaaggtacttgtgcctcgtccaatctcatccagaatcaacaggctcctggatgtggcatttcgaaggatatttgctacctccgtcatttccaccatgaaagtactctgtccgcttgcaaggtcatcggatgcaccgacacgtgtaaagattcgatctacaatgccaatatttgctttctctgccggaacaaaacttccgatctgcgccatcagaacaatcagtgctgtctgacgcatataagtggatttaccagccatattcggaccggtgataatggaaactctttttttctgattgtccagatatgtatcatttgcaataaacatatcgttttcaatcatctgctctacaaccggatgacgaccatttttgatatccagaacaccattttcattaatcttcggtcttacaaaattgtttcgttctgccacaagcgcaagagaggcaaacacatccagtgctgcaatcgccttggcagttttctggatacgtacgacttctttgccaactttgtcacggacatctgcaaacaattcatattccagcgcatacagacgatcttcagctccaaggatcagatcctcaagatccttcagctcctgtgtaatataacgttcggcattggtcagtgtctgtttgcgaacataattatccggaacctgatctttgaaagaattcgtcacttccagtgcataaccaaatacacgactgtatttgatcttcagtgtcttaatgccggtacgttctttttctcttgcttccagttcagcaagccacttcttgccatctgttcttgaacgacgatatttatcgacatctgcgttgtaaccttcgcggatgattccgccgtctttctgtgcaagcggtggctcatctgtgatcgcacatttgatcagatccgtcacatcttccagcggatccatatcctcaaaaatctgtttcaggatcggtgcttcaaattcctgaaggatctgtcggatatatggaatcatctccagtgaagatgcaaatgcaaccatatctctcggattcgctgactgatagctgatacggctgatcagacgttccaggtcatagatgggattcagatactctcggatctcatcacgaagcatcggcttctgagtcagttcttctacagcttccagtctgcaattgatctcttttgcatcaatcaggggctgttccacataacctcgaagtgtacgtgcacccattgctgtctttgtcttatccaatacccagagaagagaacctcgtttctgtttttcacggagtgtttcgaccagttccagattacgacgactggaactgtcaatcaacataaatttatctgctgtgtagggatgaatcgttgccatatgagacaaagctgttttctgagtttcattcaaatattgaaaaagtgctcctgctgcgatcactccactgtcatagtcctgaagtccaagaccttccaatgtatttacatgaaaatgttccttcaaagtgcgctggcagagactgtcatcaaaataccagttatctaatggaaaaatgcatatccgcagacggtccttcaaatcttctgtatcaactccgctcataaaaaaagcgtcattacagataatttccgcagggacaaatttattgatctcatccagaagtttctgaggtttatctacttctgtaagaaaacagtcacctgtggtgatatctgcaatggcacatccaaaatgatcctccagagaaacaatcgacatcagataattgtttctggattcatccaaagatgtggcatccagagttgttcccggtgtaactacacggataacttctctcttaacaagaccttttgctttcttagggtcttccacctgctcacagattgccactttgtggcctttctcgatcagtcgtttgatatatgtctcggctgcatgaaatggaattccgcacatcggggcacgttcttccaatccgcagtccttaccggtaagcgtcagttccagttctttggatacaaggattgcatcatcaaaaaacatctcataaaagtcgccaagtcgatagaacaggatgcagtccttgtaactttcttttgttttacaatattccctcatcatcggtgacattgccatcgttttataattctcctctactgttcactctattatcagtcatagtcaattaattataatagcatgtttaaagttttgatgcaagacgacgtattccgagattttgagaaaattcctcctctggtagaattttctttacaaaaaagtcgaaactcatgctatacttataaaaaatgatcacaacacataaaagaggtaatttctatgaaatacagagacgaaattcatatcgcactcatggcacttgtcttttcctgtgccatgtttgcagtctatgcagttgtcccaaaaaatgctgctgttgctgccagggcaaaggctaccgttaaagaggcgccagagacagctgcagaagcagaggctcttcgttccagccaggatgaagatgccggatttaacatctatacagaagacaacaactatgacgatagttccgattcttccgacagctccgattcttctgacagctcggattcctccgatcaggctacttatgatcctggaactgattattccggtgacaccggcaacggtgacgttgcagatgaaggctcttccgatcagggcggttatgattcttcagatcagatcgattatccatctgatgacggatctgaagacacctcaactgataacagttatgatgattcctcgcaggatagtggggattcttctaccgataccagcggcagcgatacttctgacaccacagacagtgccccttttgatattgccaccggagacagcaattattaaaaagtaaaaagaaaggcaatgagtacatgaacaaaatactcaaagcctttcttttttatagaatttctgttttttataatcaaagtgattccatttacttactctgtgttcctgtaaatctgcaatttgcaaacagttcatttactgcactctcatataccacacatctctcgctttttttaatctttttggcatatttcttactgtccgcaaacattggtgccagataaaaccagatttctttcattttgaaaagaacatttctatccccggacacttcctcacggtatgtatgatacagaagatcgtgaaatctacggatatccgactgatctgctgcctttccgcccctgatttcacgggcaagtgaaggatctgcgagaatacctcttcccatcataaagcattctacattcggaaattgagcatggattcttttaaaatcatctgccgaaaaaatatctccattataacatacagagttcttactgatggcaagtgcttcaccaaatgcctccagattcggagtatttttgtaaaaatccttctgtactctcggatgaatgatcaattcttccatgggaaaacgattgtaaatttccatcagccgtggaaattcctctgcattctccatccccaaacgagtcttcaccgagatcttcatatctgttttgctataaatcctatccagaaactgttccagttcatccggtctggccaaaaatcctgctccgcagccctttgtcactactgttttggatggacacccaagattcagattcacttcctgatatccatactctttcagttgattcgctgtacgtagaaaatcatctgcatttcgggtcaatatctgagggactgcatacatcccggaattattttccggagaaatgtctttcttttctctcccgctgaaattcaggttctgttttgctctgataaatggaataaaatatttatcaaatccatcaaaacactgatacagtgcttttcgataaatataactggtgattccttccagcggtgcaaggtataatttcatggattataagttaccaagatctactttatattcgtcagaaccttcctgatttactgtataatatgcagctcttctttctgcattgatataaatacagatatcacctgtcagtcctttttctgcaacatctttcttaactgctttctctacatctttcagagatacattcgtttcgaaaatttcaagagatacttcttttactcttgcaccagcagctttacgtactgcttttgttgcagtcttggttgcagtttttacagttttctctgccttctgaactgcttccggagctttgttaactacttctttcacaacttctgctgttttttcagccggtgcagactcctctaccttttttgctgctgcttttacagtttcttttacttttgctgctgtctctgtgattgcttctgttgatttagctgttgtttttacactcttttttctcataatattttcctcctgtaaacaattacaactactgtttgttgtgccgcttcttcgtaacagtaccacaaaacattacaacctgtcaaatttatccatttttacggtttctccgttaccatatccacaatccgtcatgtcgattattcttccaccagagaccccatataatagaatccatgacattcatccaggcttacctttacatattttccaagaagatctgctgttcccgggaaatgtacaagaagattatattctgttcttcctgtaaatattcctttttccctgctctcttcttctaccagaacttcctgcacagaaccttcaaatctggaagaacgaatacgtccctcctgctgtaccagcgcaagcaggcggttaaaacgttcctttgcaacatcctgcggtatctgttccatttcggcagcaggtgttccgcttcttctggaatataaaaatgtaaatgccgtgtcatagccacatttagatacaacatccagagtttcttcaaagtcctcttctgtctctcccgggaacccgacaatgatatctgttgtcagagaaatatccggaatcgctgtacggatcttatcgaccagattcagatatttttctttatcatagcgtctattcatagctttaaggatacggctgcttcctgactgcaatggcaaatgcagatgatgacagatttttttactctttgccattgtttcgatcagttcatccgaaagatctttcgggtgtgaagtcataaagcgaatacgcttcagaccttccacatcttccagcatttccagcagctgagcaaatgtaaccggatgttccagtgtctttccataggagtttacgttctgtcccagaagcataacctcagatactccgtctgcaaccagacgttttacttcttttacgattgcctccggctcacggcttcgctcacgtccacgcacatatgggacaatgcagtaactgcagaaattgttgcatccaaacataatattgacgcctgatttaaatgtataatttctttctgtcggaagatcttctacgatctgatcggttccttcccagatatctacgatctgccgctcagactggagcatctcataaaaaagttctgcatatttaaaaatattatgtgttccaaataccagattgacaaatggataggatttcttaatcttatctactacatgctgttcctgcatcatacatccaaaaaggatgatcttcatatccggattgtgatccttcagactgtgcaggtgtcccagtcttccgtataccttcaggttcgcgttttcacgaacagtacatgtattatagatcacaacatctgcttcttcattgtcctgtctgtgatacccgatctcatccataataccggccactgcctctgactgtttttcattcatctgacatccaaatgttgtcaggcagtatgtcaatggacgtccaagagtattggatttctgcgccgtcagtgcctgcgcaagttctatgaatgaacgctgacgcagcgtttcttctgcactcgtattctgtcctttagaggattcgtttgtcattttgtataactcctttgttttataaacatattgatcactaccaatttcttttttaagcactattctttaatatacaggaattttttgtccaacgcaagcgttataatgccgtccgggatacattcttgaaaaatcagagtgaaaaaagatattccagcggtaatgtatgcatttcctcatattctgtcggatcaggaaccatctcatttcctctgcttctgcgtggtatctcaattctgaacgctggctgcctgcatatttctgcataaaactgttccggagaaccataccctcgttttcctgttggttctacatcgtccagatgatattttgctttatctgcattcagtcctgcctgtttttgcaaatgtcttgcaaggcgatagcttttttgatttgcagcaaatgactgcgattgtctgaaataaacaatttgtctctcagagtagccaaaggacaaaagtcctcttcctgtattttcctgaaaaacttttataagtgcttttgtttcattttcactcgccggctgactatgaatttgttttcttctgtagtactgtgtcgggaaattttttcgcagatttacccctctgctgttacagataaattctttgcatggaatctcctgcattctcagcatctgtcgataaatcggattccggatcgcatagaaatctttctcataaatttcatatccatccggattcaaaagtggaataaaacagattttccagtcttccagtaatacccgaagatcgtacagattctccagtttccatcggcattcccatgctttgacatattctttcagcatatgcataagatatatcggcatacatcgatcccgtccacttaaacctgcaatacagaaaacagtctccgcaccttttccaatctgcaccatcggaatcatcctgtcatcatgacttttgccaattacctgaaactgcgcgatttctgtataccgccctgctatttcccacatttcataataaatattctcatatgtacagaatgtcttgtccgtattgatcatcatctttccctctgcatgtataaataaaaatcattttacgggttcctgtactattatatgaaaagagacaggccaaaatgacctgtctctcaaatctttttgtatttaatcagagttaaattactgttcttcttttttacgtttgcgaacaacgatatatccgcctgccagtaaggagagtgctgccagtgcagacattgttccgatcggtgattcatcggctgtagataccgcagatttggatttggaacctgcatctttctcagatgctgcagcagttgctgtcagttctgcatccgcatcatcaccggagccgccatttccaccattatcgccaccattatccggaattggtgttccagaaagttctgcaatatatgcattccactctttatcactgattgaagccgctgtgaaagtaagtgcctttccgttacttcccgtaatatatttaatatcctgtggtgtagcatcttcccattcttttccattataaacctgttttttcaggaaaatataaatattatagcttgcaccgtctttaatacctttaccagaaccaattctccaggttgtattctgctgttctgtcgttggattcttctttgtactccagtataccggataccatctctcatctccctgaacaggactggtattatccatacctgcaccagttacagtgaattcatagaatttacctgggaagaacttaagttctccatcaagaccagtaacagtactttcactgaccttatatgtttttgccggtctcgtagtagtggttgcagcagctgccggacgtttcttcttaaaactgctaccgtttaattttacaacactcatttttgcttttgctccggaatccggttttgcacaaattaccagccaggaatctttttccggaacttttaccgctgtcacatcaaagcttccacttgtggacattacattggtagcatcgtttgcgacatacatgttctggattgttttagtatctgttcctgcatctacaaagaaataataccatttacaaggtccatctgttgtcatctgcaatgttactgtcgtatggtctttccattttaaagtaccgctcttatatttcagtgtcagcggtgccggagttggtgtcggtgtagcagttgcttctgctgcctttttctgtaatgtagcagaaaggccattctctgctaatgccagtgtataatctgtagtatcatatttaatctgaccaactgctgtattaaaatctgctgctgcaaaattctccacactcttaacagcaacctgcttgtctgccgccttctcctgtgtaaaggagatatcagaatttgtcatcgcacctgaaacaaccagtgcagaagttcctgccagatagatattagccggctgattttcttttacaactacagttccctgtactttaatatctgaatcactgtatacagcaccttttgctccgttatttcctgtaattgtgccgccttttaatacaatatttccgccaacatttgtgattgcaccaccgttcgctgctgagttattttctttcagtgttacgccggcatccattccaaatgcagcacctgtaccaacagaaacgatggatccccctacagaagcactttcctcatcactgatcttaccggaaaccgtaaaggatgctcccgcaacgccttctttcacatcaaactgaagttcagcattctcaccggatacgttgaacatgtcttccgtaaaattagcctcttttcttgtgatcgttacagcatccttcgctctgatgcacactttcttatcagcaggtacaattactgtagcgtcaagagcaatctgtccggatatttcaatcactgtagcgtcctctgcagtctctgcatcataactcggtgctgcatcaattgcatgctgaagagtatcaaaatatcttaccttatcttcctgaccttcttctgcagctttcagtgtaatcgagattgctgtctgctctgttgtctcacctggagcaagctcttctgtttcgccttcggtttctgttgtttcactagtctctgccgcaggtgtttcctgtacagccggtgtctcttctgtagtctgctgtgtctgctctgccggtgctgcttcctgcgccggtgcctctgtagccgctgcagcttcctgcgccggtgcctgttctgccggtgcctctgtagctgctgtagtatctgccggtgtttcttctgccggtgcttctgtagctgctgcagtctctccatcaaccggattttcttctgatgtctccgctgtagctaccacatctccttctgcagcaaatacagccgccggtgcactgcttgctgcaagtgctcctgctaaaataatcgcatataactgttttcgtctcaatttaaatcctcccatggtgagtatgtaaatcttaccctcggcatgtacttaaaactttttgctttattggatcattacgaaataatttcttataaagcccaaaagtttacatgtctaaactgtaaattattatacacacgcatccagtaattgtcaaatcatagatactgttcactttgttcacagtatctatggtcaaaatgcattccaaatcaccttcggtgatggcattttgccctgtatgtctcgggattttgtcatattcatgccaaaacacctcgcggaatattacctgtgaatagtgactcatgtatcctgcgtgttctgtgcaaagcttatcgacaaatatcgatctgccattccctgttactgacggatctgtccatttccatagatgatatatttggtagttgtcagtgcaagcagtcccatcggtcctctggcgtgaagtttctgggtactgataccgatctctgccccatatccgaattcaaatccatcggtaaatctggtagaagcattgacatataccgccgctgcatccacttcatccaggaatttctgggcattggtataatcattggtgatgattgcctcagaatgtcctgtattgtaccggttgatatgtgcaatagcctcgtctacagaatacactactttgattgataatatgtaatccagatattccgttccccagtcttcctctgtggctgcaacagcccccggcatcagcgtcatggcttctttatctgcgcgcatctgtacatgcttttctttcagacggtttgcaagaaccggcagcaatacatctttgatattcgcatttaccagaagtgattcgcaggcattgcaaaccccaactctctgtgtcttggcattcataataatatcaaccgccatattcagatcagcactctcatctacatatatatggcagtttcctgtgccggtctcgatgaccggaatcgtactctgattaacaactgctttgatcagtcccttgccgcctcgtggaatcagcacatccacatattcattcattttcataaattctgcagcagtctcacgggaagtatcctggatcagctgaattgcgttctctgttatgtcattggctttcagggtttcccgaatacacttcacgatagcttcatttgaatggattgcatcactgccacccttcaagatcactacatttccggtcttaaagcaaaggccaaaagcatccgccgttacattcggacgtgcttcataaatgattccgatcacgccaagcggtacccgtttctgtccgatgagcagtccattcggacgttttttcatcccggttacctcaccgatcggatcctccagcgctaccagctgctgcagaccttctgccattccctgaattctttccggtgtaagaagaagtctgtctaccagtccttccggcatattgttcttttttccattctccacatcaacagcattggctttgatcagctcatctgtacattccacaagatgttccgcaactgccgcaagcacctggttctttttgtttgtggttatggtccgcagcatattttcagcttcttttgcattttgtccaagctctaacagcatttcattcatagcataacctccccgggacatttcctgtccctttaaataataaaaaccttaaaaaatgcttatttataaatttctttttctgtaacaatgatctccggtgaaatgtctgtaggatccaccggtacctctgacatcatctgaaattcaaatgcaactgcaacccttgtgatatatggatgtttttccagaaagcggtcataaaaaccgccgccataaccaactctgtgattctgcctgtcaaacgcgactcccggcatgatcatcagagcctcttcccactgaacgatctcacctcttgccggctccggaataccaaaatatcccttttcaagctgtgcaaaatctgtcagtttataaaataccatatcctgtccaactactttaggaaccgcaacttctttgccatcattccatgccgcttctataatatactttgtcataacttcgtgattataatccgcataagcaagaattctccggctgttgctgtattccggaagtgccgtaactgtttcagcaatttttctgctccagtcatcgatctgctgatcggtgtgtgcttttcgcgctgcaaaaacctgttttctaattgcctttttttcttccatacttttcaccaaggttcacaaccgaaccatctttttcctgaatatcaatattatttaactgtgccctgagattcttacgcacggcagccagatattcctgtcgaagttctgcctgctccttcttttcttcttctgtaagaccgacactcttcgctttatgtgccagagtattgattcggtctatcttcacattatccatcataataatttcctcctagagaagtttttctatataatcaatcaggaaaaactcttcttttttgtttcctgcaaataaggtaccatattttctgccttccatgatcttgtggatcacatgaaaatcccggccattcgcaatcaccatatccgcacctgcagccgttgctatctcggcagcagtcagttttgtagccattccaccggttccgactttgctctttggtccttttcccatactcagaagtttctcatccattacttcgacagtatcaatgaattctgcatccggattcgtattcgggtcatcggtaaaaagtccgtcgatatcagaaagcaggatcagaagatccgccccgatcaatcccgcgataactgctgacaatgtgtcattatcaccaaaggattccagcatctccagctcgtagcttgaaatggagtcattttcattaacaaccggaattgccccgagctccagcaactcttcaaatgtattccgtgcatttctgcggttcaggttattgaccatcgtattctttgtcatcagaatctgcgccgccatctggttgtactctgaaaaaagtttctgatagatcatcatcagacgcgcctgtccaactgcggagcatgcctgttttttcttaagttctgtcggcttctcatgcatgccaaatgcagatgcaccaactgccactgcacctgaagtaaccaggacaacatctttgccctggttatgaagatcactcagttcccttacaagcacttccagtttacgaagatccagtttatttgtttccttgtgaatcaaagaagaagaaccaactttgatcacaacacgttttttgtctttcagtaactcacgataattcatggtatttattctccagtaatttcttctgcgatctgtttcaggtcatcacctgtaaacagtctctgttctctattgatagctgatatcatccactctgtcatcctgtacgatctccacccaggtcgttcccggattcagctgaacttcctgattatcatctgtaatataatgagtcacaccccatggggaatctttctgccaggtgacattgattgctttccctcttgtgatatatttgcctcgtccaccggaatttccgtcacgatcggtaatcgtctcaatatccttatagcttgttccctcatatgtagtcacgtaagagtactggatcaggatattgtcacaggtcagttgctctccggtaagatcatcgatctgtgccgcaccatactggaaacggctgtatttttttgtattttcatcataaacaaaccatggatgattcactgtaaaattatcaaaatgtatctcctgtgcggatgtaccctgcggaagtgtgttttcagttccatcaggtacaaacacatagtgtccatcataatcttctttgtattctctgcggtatcccatcttgtctataccctgctgaagcaggtcatatgttgtataagcattgtgcggagccttacggtcagtactcctgaaataacagatttttcccagtttcacgccattcagattgtcgatcagatgctgttcaaaatatggaagtgcaaaagcagactgtccataatgtgcataaattgcatcaaattcattcgcataaaagatataataatctctgcagcttctgacggaaccaatccgttccagatctttataatcctcaaaaattcccatcagtcttgtgatatcgccctctacaggtgcctcatacacaacaccggcattcgcgattccactctgtgggcatccctgcttaatattattcagcataaccgctaccgggcggacccggccttccgattcgggaacatccagtcctgtaaggtagcttttcaccatagtatcagcaaatacaccaacaggtgtcgttcctatcataaccaatgccataactgctgccagaaatttcttcttcatagatgttctcctttcagatggtgatcatcacctagtaattcccagatcctccagtgcctttgcctgcttggcctccattaccgctgcctcatccggttccatatgatcatagccgagcagatgcagcatactgtgtgcaaacaggaaactgaattcccgctctgtgctgtgtccatattcttctgcctgcgcatagaccttatctacagagatcataacatccccaaggatcagttcatctgtatcaagatcaaaatagctgtcatcgccctcgatcactgaataatctgccggtgtcttaaacgggatcatcgggaaagaaagtacatctgtcggtgccccgattgagcgaaattccgtatttacccgtttgatttcttcgttgtcagtaatcacaagatttacgcagacatcataaggacagttctctgtctcaagaatatgctcagcgacttctgatgccagtttttcataatcaatatccagtttacgttctgcttcataatcaatttgtatggtcattctttttcctccggactgtccttgtaccaccggtacttctggacggtttctgtttcttttcgtaatcttcatatgcctgtacgatctgctgtaccagcggatgacgtacaacatctttgctggtaagctggcaaaatccaatatcatctatcttcttaaggacctttgccgccacatcaagaccagatactgcatctctcggaaggtctttctgagacgcatcaccggtaacaaccactttggagccaaaaccaatacgggtcagaaacatcttcatctgtgccggtgttgtattctgtgcctcatccagaataataaatgcattatccagtgtacgtcctcgcatataagcaagcggagccacttcgatcagccctcgttccatattttttgcgaaactgtcagctcccatgatctgatataatgcatcatacaatgggcgcagatacggatctactttactctgaagatcacccggaaggaatccaagtttctcccctgcttcgatcgccggtctggtcagaatgatacggctgacttcttcatttcgaaatgcggtaactgccattgccatagcaaggtatgtcttaccggttcctgcaggtccgattccaaatacgatcattttctttcggatctgttctacatattcctgctgtcctaatgttttgggtttgattggtcttccctgtatcgtattacagataaaatctttatctatttccgtgagtacctgatttcgttcctccatggcaagagacagtgcataacttacgttctgccgtgttatagtattgcctcttcctgcaagcgtcaccagttcctctatcagtttttttgcctgagttgcactctgttcggtacccaggatcttcagcatgccatctctggatatcagtgttacatttaacgtccgttcaatcagcttcaggtgttcgtcaaactgaccgaacacatttccctccagatctgcaggcacctgcgtatatagctcgataatgctgttagccatcctctgttgtcctttctgcaggctgctccggtatttctacaggagtctcctctccgattttttctataatttccaaaaaacctttgcttacacaggtcttgtggtcaatttctattttaacattatttgcagatatttgaacccctttttgcattaatttttcttcatacctctgcaaagtatgccatgcaagtttttttacttcttcccttgtatactctttttttatctttctgtactggttttgggtaatataccctattgagcacggcaactgaaaacttttggtcagatacattttctgttcttctgcaatctgataccagccattttttgtcctgtctgcaatttccaaataaaatctgcctgctttcagatagataccctttttctttttaccggtccattcatatgtctcatagatcattggaatctcatgataatatgccttctgtctttttatataaatatctgcatctgcatgaaccgcttcatactttacaacctcctgactgtcatcctttaattccagtattcccgataccaggatttcaccttttttacataaatccccgacctttttccggggcagtccgcttctggttatcatttttatgatctcaccatcgcgttctgccataatatcacaggcagatttgtccttttcttctgtagtctgtataaatatcccttctctgactgtaaggagcagtctggttccctccagttttgctgatacccacgtaatatccggatattttttacggatctcagctgcaatctcactgcagctgagcctttcttttgccattccatgcctgattcctttttgttccagaaaatccagtatctcaggtgtgctgtttctgacatttccctctacatcaatttcccacaaccgtccggacaggaacaaaagcagtcctgcacataaaagtaatccaagaaaaaaagcctttctctttttacttcggtaaaaaaagaaaggaagtccatgcttttccagaatatgaatttttacttttgtttttctatgtattggagcgagtctgaaaaaatctctgatctgcagacatcctgtcagactcagttctgattctcttctgagatcactgattcgaatttcacgagctctgcacagattcagaaaacgttctgtctgttccccatatattctcacacgaacatatccatttcgaaacccggcatactttttcataatctcctcctaaccttccaggataatctccgtaatcacaccttcaatatacatttcttcaggtgtatacatcgggatcttcagtctttttccctgtattcgaagtttcccctgaaaagtcagtaatattatttcttctttctcataccgcaaaacacttcgatagttgcagactactgcctgatgttttcctgtaacagtaaacaccgtttctttcattgccagatctctcggtatttccagcgaggtaacaagattttctttccattgtcccatctttttcataacaaaaacctccctggcgctcattataaatgtacgccggagaggtcttgtttattctctgatattttatttaaaaagcaccatggaaaaccagagtatcgtatttccgcccagattatactccatctgctgtttctctacgatctcacttactaccacgccatggctttccaggcagggatgcattcggtccggatgtctgcacggtttgccatgtggatatgcacagtcctcacagatatcacaggattccgttgaaagtgtaaacgtctcaaatccctgttctttcaaaaaacgggcaacttccgttgtcagttcttcgtgtgcagctcttgtttgcagcatttcctgcatattcataagatcagaaacttctgccacactggaaaagaaaacagcctgtccaaacttgcggattctttcctcgcattctttcagagtacccacagccggcggacatgcccaggtcgatccataccgttcacattcctgctgacagacgatccttactctctcctcgacagacagatctccggtattcaggatacgatattcaaagatcggatactgcgcaataaaatcttcaaatttatcaatattcagttctgccgtcatcagggttcctccattttaattaatccagaataatcagcgccatgaatacaaggtcttcatcgccgctgtttgtaagtccatgtcctttgccgtccggagtaaatgtcacatcaccggcctgcaccatacggagtgttccattatcgctataaataccttttcctgaaagaatataatacgtttcactctcattatgatgttcatgatatcccagagaacatcccggttccagagttacctgcgcatataatttgcattttccgtttaactgcttctcatcaaggagacgtttcaccaatgtatgtccctgtccacctgccatatgttctactcgttctgttgtcatatcactatatcctccttttttggaaatcatttattgcaagccggagttatttccggtttgtgtctttttatttatgataaggttcatggttcaggatcctgtagccacgatagatctgctccagaagaatcatctgcatcagctgatgaggaaatgtcattctggaaaagctcagtttataatctgctcttttcagaacttcattgccaagacctaacgagcctccgatcacaaatgcgacagaacttttgccttctacacccagacgtccgattttttcggataactcaacggaatccagcattttaccatcaatcgcaagcgcaattacataatcctgttcccggatatgcttcatcagacgttccgcttctgtattcttaatctgctcgttcagtgcatcagatgctttatccggtgtcttttcatccggaacctggcaaaatgtcagtttgcagtaacggctcagacgcttcgcatactcggcaattccatcattcagatatttttctttaattttccctacagttatgatcttaatttccatttacaggtattcctctatataattttcaaattcttctgcagacatcagtaccttacgaggtttcgttccttcctccggtccgacaacccctgcatcacataactgatccatgattcttgcagctctgttgaaaccgattttgaacattctctggagcataccgatcgatgccttttctttttcaataatgaatttaccggcctccacaaaataagcatccctgtcgtcagccgaagaaccaccggtgccaccggacatgcctgccgtatttacctgctgttcaatctgggaattgtactgcattcccggattcttttctgccaggaagtcaacaatactgctgacttcttcatcggatacaaaagccccctgcagtctggccggtttctgatatccctgcggataaaacagcatatcgccctttccaagaagcttctctgctccattcatgtcaaggatcgtccttgaatcaacaccagaagatacagagaatgcaattcgtgacggcatatttgccttgatcagaccggtgataacatttacagacggtcgctgtgttgcaatgatcagatgaatacctgcagcacgtgcaagctgtgccagacgacagattgcatcttccacttctccaggagcaaccatcataaggtctgcaagctcatctacaataattacgatctgtggcatcttctcagggcgctcttctccttccggaatacgcattccttcaactttgcggttatattcctgaagatttcgaacactgtattctgcaaacgtattgtaacgattcatcatctctgttactgcccagttcaatgcaccggcagcttttttcggatccgtgacaaccggaatgaacagatgtggaataccgttataaacactgagttccactaccttcgggtcaatcatgatcaatttgacatcttccggagatgctttgtacaggatgcttacaatcagggtattgatacagacagatttaccggaacctgtagcacccgcgatcagaagatgtggcatcttggcaatatccgtaacaaccggttttcctgcaatatctttaccaactgcaaaagacagcctggactttgcactctgaaattcctgtgactgaaggatctctctcagcataacagcatgattttctttgttcggtacttcaataccaacagccgctttgcccggaatcggtgcctcaatacgaatgtccggcgttgcaaggtttaatttgatatcatctgccagattgacgatcttacttactttaacgcccatttccggctgcaattcatatctggtgacagttggaccgcagcttacattcgtcacagttacattcacaccaaaattatgcaatgtatcctgtagcttcttcgcagtcttgcgaagatgttcatcggagtctccctgtgatttgccatctccacgcttcagaagtttcagcggcggataatgatactcacgcttaaccacttcattctgctgtgtaatctctttctggatattttgaattccactttcaatctcctgtttggaagacttcggatttttgactgactgtgaagcaggtcttgtctccggctgcggcacagattccggaacattctcagacaccggctcctgcacctgctgtacttccgcatatgtttctaccggctccggttcagaatagcattctgataattccggtacatcctgctctgccgttggctgcacatagctatctgatggttcctgataaaattcttccggctctgcacggtgaatctcaaacatcggagtctgtggtgaagccatcgccatcgtgttctccacaggcatattctcaggcatctcatccttctggtcctgcctcacagtttccccgtgttctgcatttcctgcaaaatctgaagtcatatctgaaactacagctacggaatctgtatctgtggcagtatcattttttatgccttctgcagtcttcttatgatctctgagcactgtcttacgattctttttcttctttgcttccggtggaacaagcagcgtcccttcaagaaatcctgtagatttcttctctttagccgcagactcttctccatcattgttttcctgtgccagagcctcttccagttcgcgcacacgctgcgcctgccgttcttctctcctctgtctgcgttcctgcacacgaagctctttgcgaagatctcgctccggctgtccctccatatacatgtcatgtccatctctggcaagtgcacagactgcatcccagatacggaatacaaaaccaaaaaatgatttctgcgtgatcaatatcagagagatcagaagtacaagaataataatcacatatccccccgcaacaccaaatgcggaagtcgtagaaatgcagatagctccaccaagcacaccaccacccgttctatatgtagaacaggtcgaataatactccgacattgtagtactggacatatatccctctgtcaacagctgaaccaggccgcacagaaaaacaaaaaacacaagcgcagcaagtgcttttttgtatgcaagaggattcttactgttcgatacaagaaatgcagcaccaacaaagatcaataccggaaaaacatacgcaagcaatcccataatcccgaaagatgccttactgatcgcagcaccgaccactccacccatgccaagattactgatgatcaatatgatcgaagccgccagaattgtcagcaaaatgatctctgtctggaatccgctggtaactccctgctttttcacctgttttctggtctgtttttttctcgtatttttacgtccggaagtggtttttgcgattcctcttcggttactctgtttctttgttgctgccattcaggcacccctcctaatgattcttcataaaaatccgccggaaaatcagaaaatcctccggcagaaaaaatattcccaactatgcaaaatttgctacaagcgcaataattcccacaataaaacaatagtatgcaaaaaagcggaattttccgttgtgtacaagtctcaggcatgcccggattgccagacttccaacaactgctgcaatgatcattccaaatacataagaaaagccaagccctactgtcatatctgcagaaccaaactgcccaagttccatgatcagtgcaccgataattgccggaatcgacaaaatataagaatacttcactgcaaatgtacggctgaatccgctcatcaacccggcactgatcgtcattccacttctggaaaatcccggaaataccgaaaggccctgacagattccgatccacatggcattggaaaagcttgcatccttagctgcttttgtgccgcctacctgactcagatcaattaccagaagaataatccccgtgatcagaatcccaacacccggaagaagttttgaagctgcagacattgcaacaagtctgcgtgctgtatatcccagaaacatcgtcggaatcatggaaaccatcagtagaactgcaaatttacggtagatattgcttataatctttgcataatgaagctcatccccggtacgtctgttatgtatatagagatttgcatttccaatcacatccataaacatttcaatggattccactgccagtctgcgaatatctttctgaaaggtcataaaaactgctgcaagcgttcccagatgaagcataacttccataagtacacccgggccatgctccataccaagtatattctgaacaaaacaaagatgtccaaaactgctgaccggaagaaattctgtaattccctgcactatagccagtaaaataatataaagaactatcatatttttatccttttctttcaactaatctgtaccatattatccggtaaatttctcataaccgcctataaaggcatattaacagtggatagtataacatattcccgaaaaacttacaagacagcaaaaaagaacttgtgttcttattccattcaaaaaaagaccttccgacacatttctgtaccggaaggcccctgattcattttatttatttttcagatattcatcgataccttttgctccagctttaccagctcccatagcaaggataactgtagctgcacctgtaacagcatctccaccagcatatacgccgtctttagatgtcttacctgtttcttcttcagcaacgatacatcttctcttattgatctcaagtcctttagtagtagaagagatcagtgggttcggagaagtaccaagtgacatgataacggtatcaacatccatatcatactcagaacctggaatctcaacaggacgtcttcttccggatgcatccggctcgcccagttccatcttaacaaccttcataccgcttacatgtccgttctcgtcaacaaggatttccttcggatttgtaagaagatcaaagatgattccttcttctttagcatgatgaacttcttctgctcgtgcaggaagctctgcttcacttcttctgtatacgatatgtacttcagcaccaagtctgagagcagttcttgcagcatccatagctacgttaccaccgccgacaacagcaactttcttacctgctgcgatcggtgtatcataagagtcatcgaatgctttcatcaggttgcttcttgtcaggtactcgtttgcagagaatacaccgcttgcgttttcacccgggattcccataaacatcggaagacctgcaccggaaccgataaatacagcttcaaatccttcatcttcgatcagctgatcgattgttgtggatttaccgataacaacgtttgtttcaaatttaacaccgagttctttaactttctcgatctctttcttaacaactttctgttttggaagacggaattccggaataccataaacaagaactccaccaagttcatgaagagcttcaaatacggttacatcatatccggcctttgcaagatcacctgcgcaggtaagtccggacggaccagaaccgataacagcaactttatgtccgttcttaacttctgctccgactggtttaatatcatgttccagagcatagtcagcaacgaatctttccagtttaccgatagaaacagcttcacccttcttaccacggatacactgtccttcacactgagactcctgaggacatacacgtccgcagatagccggaagtgcggaagataatccgatcactttatatgcttcttcaatgtttccttctttgatctgctcgataaatccaggaatattgatggataccggacatccttctacgcatttcggttttttacagcccagacatctctgtgcctcttccattgcttcttcctgattatatccaagacaaacttcttcaaagtttgtagcacgtaccttcggatcctgttctcttaccggtactttatttaacatttttgcatctgccattacttgtcacctccgcactgtccgcatccaccgtggtgggtatcgccttcctgaagcttcagtaatgcacgtccttcttcagtcttatacatctggcttctcttcatagcctgatcgaaatcaacgagatgtccgtcgaattccggtccgtctacgcaggcaaatttaatttcatcgccaacctggagacgacatgctccacacataccagttccatcaaccatgatcgggttcatgctgacgattgtgtggataccaagcttcttagtaagaagacagacaaatttcatcatgatcatcggtccgatcgcaacacagacatcatagtgtttaccttcatttgtaacaagatcttccagagtctttgttaccataccggaacgtccataagatccgtcatctgttgtaacataaaggttggaaacagctgcaagttctttttcaagaataaccatatcctttgttttggaaccaaggattacgtctgcagtaataccatgctcgtgaagccattttacctgtgggtaaacaggtgctgtaccaacacctccggcaacaaatacaagtttctttttcttcagttcttcgatgtcttcatgaacaaattcagaaggacatcccagaggtcctacaaagtcacggaaagaatctccagcttttaattcggacatcttaatagtagatgctccaacttcctggaatacgattgtaatcgttccttcttcgcgatcatagtcacagattgtaagcggaattctctcgcccttctcatccatttttacgatgatgaattgtcctggctgacaatggcttgcaacacgcggtgcgtgtacgaccataagatggatcttagctgccagtgtttcagcttttaaaatcttatacattgtttccctcctagcatattttcattcaatcctctaataataatacgctaaaatctgctatatgacaaggaaaacatttataaagatgcataaaaatgtcttttttttcacaattttttatattttattatttttcaatcatctcatgcagttttgcaagtgcctcacggattcctccaatctcatcaatcagcccttcttttactgcctcctcaccttccagaagcgttccgacatctttgaccagttgactggtatccagcatcagttcttccagtcgttcctgcgaagctctggaatgtgtcgcaataaagcctgtgatacggtcctgaattttttccatattacgataggtctgggccactccgataaacatcccactcgaacgcaccggatgaattaccatcgtggcacttggcacagcaaaagaataatctgctgacacagccatcggcacaccgattgaatgaccgccgccaagaaccagagataccgttggaatactcaaagaagcaatcatctctgcaatagcaagtcctgcctccacatcaccgccaaccgtattcaaaagaatcagaagtccttccacgttttcatcgtcttcgatcattgcaagttttggcagaacatgttcatattttgttgttttactctgcgacggtgcagcatcatggccttctacttcaccaatgatcgtcagaagttcgatccggtgtctcttcacattctggtcaagtgtcaactcacccatttccctgatctgctcattttctttttcttctttatccaaagcctgctgtttgtcattctcgatttctttttcagacataaaaaatacctccatgaagattcatgaaggtattttgcgtcaaactacgctctgttatacatacagatcatatcattcgttccagtttgtccaaacatctgtaacatcatcatcctcatcgagaagatccagtgttctctgcaggttcttgacatccttttcatctgtcaaatccacatatgtctgcggaaccatagcaacctgagcttctaccatcgggataccagctttttccagagcctcacgcacggcactgaaatcatccggagctgtcaggatctcaaagctgtcttcttcttcgttgaaatcctctgcgcctgcatcaagtgctgtcatcataagctcgtctgcatccatctcaccacattcgtcttccagttcttctttatcaatgatgatctgacctttctgatcaaacataaaggatacacatccctgagttccgatgcttccataaccttttgtaaatgcatttcttacattacttgctgtacggtttttgttgtcagtcagagtctcaacgatgattgcaacaccattcggaccatatccttcatatgtagcacgttcataactgtcagcagaatctgcaccggctgcttttttgataccacgttcaattgtatcattcggcatgttgtttgcttttgcttttgcgataacgtcacgaagtttgctgttgttgttcgggtccgcaccgccggctttgactgccataacgatctcacggccgattacagtaaatactttacctttttttgcgtcatttttttcctttttgtgctttatgtttgcgaattttgaatgtcctgacatttttcactctctccttttgtttctttgtcatttattttttcggctcttactcttccgatggttctgtttccaagtgaaagaatcttaaatctgtagccgtttgcaacaatttctttgtccagatcctccctggacggaatatgtcccagaagctctgtcagataaccgttcagcgtttccatttctacatcaccgaattcaatatccagttcctgctccacatcatccagactggcaagtccatcaataatgatactgttatctacctgtgtccgaaatgtatccctgctctcatcgtattcatcaaaaatatccccgacgatttcctcaatgaggtcttccatcgttacgattcctgccgtctgaccatactcatccacgacaactgccatatgtacctgtctggcctgcatggtacggaaaagctgtccgatatgtctggtctcaggaacaaaagtcgctttcctgataagccccggaagctctttcagtggtttgaacttcgcccatggattctgtgtaaagaatttcagtgcatctttgtaatggatcagtccccggatatcatccatatcttccccgcagaccggatatcgggaattttcctcttccatcatatgattcacaacatccttgagcagatcatccatcgcaaaagcagccacactgcttctgtgagtcataaccacacccacttctttatcttcaaaagcaaaaatattctggatcatctctgcttcatctttctggaggacacctttctcatgtgcctcatccaccatagagatgatttctttttccgtaacagaatcttcctgttcccctttaaagaaatgaaaaactctgaaaaaaaggccctggatccagtctataaccttcgccggccccctgcggggcaatcgactgccatcgtccattttgtatctattccttccgtaatttgtttaaaatcagcacaattactgctaaaatatagcactttagcttctgttcgtcaaggataacagcctaaaaagtaagttcaaggctgatttcaagggcatgattcactcgatccagcattgtctggtcaagatggcataccttatccttcagcctttttttatcgatcgtacgcagctgttccaacaagatcaccgagtccttctcaattccataagaagaagcatcgatctcaatatgcgtcggcagctttgccttattcatcttagaagtaatcgcagcacagatgaccgtgggactgtgtcggttgcccacatcattctgaatgatcagaaccgggcggacaccaccctgttcactcccaactaccggccttaaatctgcataaaaaatatcccctcttttaattaccacacaatcacactccgattcttttttctctggaattagtatttccatttttcttctgtgtatacatgcgtggtgctgcagtttattcgaagaaggtcagatctccccattctctgccgtcttttatatagactctcgggacacgtttactgatatcgcaggcaaattcataagaaaatctgccggacatatcgccgaaagtctcaatgctgataaattcgtctccgtccctgccgatcaatgttacctcatctccatgtttcacatccggaatatgtgtaacatccaccatgaactggtccatacagactctgccaaggatcggtgctttctgtccatgtatcagaacccatcctttattagacagagttctcggatacccatccgcatagccaaccggaatcgttgcaacacgaagatcgttttcggaagcaaatgttccgccataactgatcgccgttcctgccggaagatccttcacataagccacatgactcttcagctccatcgccggcttcagtttcacaatgtccctctccacttcatcggacggataaataccatagatcgtaattcccgcacggaccaggttcaggtttgcctctggcatacgaatgattcccgcactgttcgagcaatgcttcagcggaatctgtactcccgccttttccagaaggtcagcaaacgtaagataacgtttcagctgttctactgccggagctttatccgtctcatctgcccgcgcgaagtgtgtaaacataccttcaatctcaacatttggaagtgcggcgatctttttgatctcctcaacgctttccggcttatctgcaaatccaatacggctcattccggtatccagtgcaatgtggatatgcacctgtctgccctggcggactgcctcatcagaaaggatttttgccacatcatactcacagaccgtcaggcgcacatcttttctgatcagttcctggaaatactcttcaaaaacaagtccgagaatcaataccggtttctcaatcccggcatctttcaactgaatcgcttcctctgctgtcgcggtcgcaaatccccagatgtactcatagtcttctataagacgcgaaatcgcttctgcaccatgtccataaccatcggccttgataacagctacgatcctggtaccatctgcaatgtttttcttcatttcctcaaagttatgagcaatggcatccagtgatactactgctttaactctctcaaattttttcataataccctcctcttcctgcctgatctgctcagatatttcggtattctatttatttttcaaaacttctgaagctcctcgcacaatatctccggccttcatacctgctgttcctttttctttcgctgccagatctcctgccataccatgaagcagtactcccaacgcagcctgtctgcctgtatccggcagttccgtccttttattcaggaacattgccagcacacctgcaagaattccggtcagaacatctccacttcccgcagtcgccattccaggatttcccgccagactgatccaggtatttccatccggtgctgccgtcacggtacatgcatctttcagcacacaaaccgcaccggtctctgccgccagctccctcgctgctgcaatacggtctttttgaagttcactgaccttttttcctgtcagccgtcccatctcacccatatgtggtgtcatgaccacgcggctcgtaagatactgtttccattccggatgctgtgccagcagattcaacccatctgcatccagtatgactggtttagcagctcctgatgctgcctccagaaaccactgtactttttcggcagcctggtacgtagttccaattcccgggccgatcaccacaatatcgcaccagtcaagatcttttgcaaaatcatcgccacagtcaagcattgcttccggcagcattgtctgcagtggaatctgattctcttctgccgtaacgattttcaccattccgatgcccactgcaaaagctcccgacgcactgaggtaagccgccccacacatgcccggacttccggcaacgaccagaatctttccaaaagttcctttgtttccatcaacaattttatccggcagaaaatgaatatctgttttttctgtctgccataaatatggtttcaccttatcacttgcgtagatgccaacatccgcaacgatcactttaccggcaaatttcctgcccggatacaggcaaaggcctgctttccgaaatgcaaatgtcactgtcagatctgcatgaaaagcaattccaagttctgctcctgtatcgccatttactccggacggaatatcaacagccactttccaggcattcaactgattcagtgccatgatcacatctctgtaactgccctcgaccggacgactcagcccaacgccgaaaatggcatctactatagtagtatattcctctgtttccaggttattcacaaccggcacctgacaggcagctgcaatatccagctgacgctgcatttccacagtcctgtggtccggattccccaccagatacagacttgtacgataaccatgcagtttcagaatacgggcaacagccacgccatctcctccgttgttcccgcttccgcagacacagagaatccgttcttcctgttttttgtctgccagcgtccgttccagttcttctgcgactttcagagctgcccgttccatcaggacacaggacggaatcccgattccctcaatcatatttccatcaagagctttcatttctttacaggtcacaatctgtttcattctttttcctcacctgccataattagcataaaaggccattacgcagcctccttgccataaggagccgggtaacagcctgtctgtccgtcctgccatcactttataagtgctgcttatttctcatcgtctatatgttcctgacgatactgactgagattataggataatgtcataagactctctgaaagatgaacattctccacgatcacatcatccggagtatccagatcgatatgtgcaaaattccagatagctttgattccgttctcgatcagaatctccgccatatcacgcgccttattcttcggcaatgtcagaattgcaatctcaatattgttttctttcataaagaaaggaagatcactgatcatctgaatctcaatcccacgaaccgcaattccctcaagtaccggatttacatcaaaaataccgaccagcttgaatcctctcttctcaaactcaacataattggcaagtgcctgccccagattaccagctcctacaatgatcatcggatgcacgatatccagccccaggatcttaccgatctctgtataaagatattttacattataaccgtatccctgctgtccaaatcccccgaaattattcagatcctgacgtatctgagacgctgtaacacgcatttttttactaagatcattggaagagattctctctacattgtcttccagaagttcaccaaggtatctatagtaacgtggcagtctcttaatcacagcttttgaaatctgttttgcttccaccgttgtccctccttacactttctcgttaattataacgaattgacattttgttgtcaatcaatgttgtcaaatatgtacaattttcattgattttcctttacaaaggccatttttgcttttataatcataccgtatatttacttcggaggaataactatgattttatcatgtcagggtatctccaaatccttcggtgaaaaagtgattctggaagatgcctcttttcatatagaagaacgcgaaaaagctgctctgatcggtaataacggtgccggcaagaccacacttcttcgcattataatggaagagatccatgcagatgccggacaggtagttcttgccaaggacaaacgcatcggttacctcgcccagtatcaggatgtacagggacatctttctgtatatgaagaactcttaagcaccaaacagtatatcatcgatatggaagaacgccttcgtgccatggaagtccagatgaaaaatgcttccggcgaagaacttgaccgcctgatgaactcctacacccgcctgactcatgaatttgaactggagaatggctatgcctacaaaagcgaacttatgggtgttctgaatggtctcggatttacagaagaggattttaccaaacaggtggcgactctttccggcggtcagaaaacacgtgttgccctcggtaaactgctgatttccaaaccagatatccttctgctcgatgagcctaccaaccacctggatatggaaagcattgcctggctggaaacttatcttctcaattatcctggtgctgttttcattgtatctcatgaccgctattttctggacaaagttgtcacaaaagtcatcgagatcgatgccggacaggttcgtatgtatgccggtaattactccgcttatgcagagaaaaaagcacagcttcgtgatgcccagtacaaggcatatctcaaccagcagcgcgagatcaagcatcaggaagccgttatcgtcaagctgaaatctttcaacagagaaaaatccatcaaacgtgcagagagccgtgaaaagatgctgaataaggttcagcggatcgacaaaccggtcgaagtccagagccagatgcgtctttctcttgaaccacgcgtggtcagtggaaacgatgtccttaccgtagaagatctcgccaaaagtttccctcagcagaaacttttttccaatatttctttccagatcaaacgaggcgagcgcgtagcactgatcggaaacaacggaaccggcaaaactacaatgctcaagattctcaacggacttctggatgcagacgccggaagcttctctctgggtgccaaagtgcagattggttactatgatcaggagcatcatgtacttcatgcagaaaaaacaatttttgaggaaatttcagacacatatccgacactgaccgagacacagatccgtaatatgctggcagcatttctctttaccggagacgatgtattcaaagtgatctcctctctttccggtggtgaacgaggccgtgtttctcttgcaaaactgatgctctcagaagcaaacttcctgattctcgatgagcctaccaaccacctggatatcgcatccaaggaaatcctggaggaagccctgaacagctacaccggaacggtactgtacgtttctcatgaccgttatttcatcaaccagactgcaacccgtattcttgatctgacaaatcagtctgttgtcaactatatcggagattacgattattatctggagaaaaaagaagaactgactgagaaatatgctccgactgcacaggaagccaccgaagaagctaaagaagaaacaccttctgagggaaaacttacctggcagcagcaaaaagaagaacaggctcgcaagcgtaaacaggaaaacgaacttaaaaaagtcgaaaaacgcatcgaggaacttgaaacacgagataaagagatcgacgacactctcgttcttccggatgtctgtacgaatgtaggacgctgtgcggaactgagccgcgaaaaagacaagattcaggcagaacttgaagaattatatgaaaaatgggaggaacttgcataactgcaattttctctcccaatattacaggagccactgtatcgcagttgatacaatggctcttttgtgcgtatattaaatcattttttccagagattctctgattgcaaggatgaaatcacggctgttcagtacagtcggattctcaattgttgtgatcagtgcaaggtctttggtcatcttgccactttcaatcgtggaaagggtagctttttccagtttatctgcaaactcttccagtttctgattgccatccagttctccacgtttacgaagagctcctgtccatgcaaagattgttgctacagagtttgtagatgtctcttttccttccagatggcgataataatgtctctgtaccgttccatgagcagcttcgtactcataatagccctgtggagaaacaagtacagaggtcatcattgcaagagaaccaaacgcggaagaaaccatatcactcataacatctccgtcatagttcttgcatgcccagataaacccgccttctgctttcataacacgcgctacaatatcatcgatcaggctatagaaataagtaagtcctgcttcttcgaacttatccttaaattctgtatcaaatacagtctggaatacttctttgaatttcgcatcgtatgtcttggagattgtatctttcgcgccaaaccatacatcctgttttgtatccagtgcatagttgaaacagcttctcgcaaagctttcaatggatgcagtcatgttgtgcatgcccatcgcaactcccggtgctttgaactcctgtacaagggagcgtttctcttcaccgtcttctgaagtataaaccagctcaaccttacctggtttgtcaatgtacatctctgtattcttgtaaatatctccatatgcatgacgcgcaagtgtgatcggtttcttccagttgcgtacacatggctcaattccctttacaacgatcggtgcacggaatactgttccatcaaggattgcacggatcgttccattcgggctcttgtacatcttcttgagatcatattcgtccatacgtgcatgatttggagtgatcgtcgcacattttactgcaacaccatatttcttagttgcttcggcggcatcaatcgtaacctgatcatctgtttcattacgataagtcaatccaagatcataatactctgtattcagatcaataaacggaagaagaagttcatctttgatcattttccagagaattctggtcatctcatctccatccatctctaccaacggtgtcgtcatttgaattttttccataatacgtctcccttgcttgatatctgattttttgcaactgtttatctccgaacaattgccaatttcctactattctatccgaaaaaaggatttccgtcaatactttcagcctttactatggtaaaatcgtgcatttttgtttatacaatcatgtgcatttcctataatgccaaaaactttttgcagttgaactttccccatccctgctggtttctcggcagtcccatatcatcgcagctgtctcgcagcatcattttaatctctacattggaaagcagagaatctttttccagtgccagcgcaatcgcaccggacaccagcggtgttgacatggacgttccgcttttcatgctgtacaggtttccagctcccggcgtacatgccatgatctgccgccccggtgctaccagatccggtttacacacgcattcaaatgttggtccgcgcccggatactgcccgctttcccgagagcatatcactggatcccaccgtaatgatctttttgctgcatccaggtgccgtcacgctccccggcttcggtccctgatttcctgccgccgcgaccaccaccaggccttcatcccataatttctccacaccctgcaccagtacatcctgctcgtttcgcgtacgataagtcgttcccacagaaatattaacaattcgaagcttgtatcgttccctgttctgtaaaatccagcgaaaagcctgcaggacatcttctttatttccatttccaaaccgatcaagtactttcagcgctgctatcctgctgcctggtgccatccccttatattttcccatggaggccctgccactcccggccagaattccggctacacaggttccatgtccattgtcatcatatggagattttttatgcgctataaaatccgcaaaaacacagattctgctgtcaaaatctatatgcggatagattcccgtgtcaagaattgccactccgattcccttccctgtataaaatgactcattcatgcatatactccagataaaggtttctatattaatatattccagtttcagtgaaagggggtgcggaatttgatcattgtagcacttattgtgtttttctgcctgcaggcatttgtgctcttctgctgcctcgccgccggaaatgaccccggatcacaggaaatatccgaccaggaacagatggaatacatccagatgtggatgaaagataaaaagcggaaagcctgatggcttcccgctacaaacacataatttatctagttattacggagcaacaacatctgtttctgtctcaccaacatcttctggtaattcacggtaaatcactgcaaccggaccacctgctgaatggaaaccaactttaatctgattgtctccaaccttttctgctttcaaaatttcccaaccatgttcttcacaacgatgaagcatgaatggctcaatcttatctgtcaaattatttactgtaaacgtaacctctacaatattctcctcagacggttcaccttcgattataaggttcataacaggagaaagaaatttgaattctgacaaatccatattttcctgtgtaagctctgccgcctcataaaaatcaacctgtggaatattttctacaccaaaaactgtttcaaaagcagactctactatagtatctgcatcagattgatgcagttccaaaaatactatctgctttttcttggatattaccaacagttatatccacagctttatatacataagaaaatatgtttcgtgcataacttccatcttttctaataatttctatacattctctccgcgttaatgttgcttttgttgtgtcactctcacccaatctaagcaacatataccatccaatatatggatgatcatctattaaattcagtataaaatccgactcatctgcatatgtattaattattttataaagcatatcactaatctgtgttatattccattaaatatattccatcatgttgaaactttatatcgatattctgaatgtatttcaattatagaaaaactctcctatactctgaatctccagcatctatcagatgctccgttcaaaatataagagagcttatcacttcatctcacctcttcatatccaaatactgctccaaaatccttaatatattacttgtattctcctgatattctgctgctgacagtttatccactttcacttcagaaatttgtttctttttcttaaattcctccgatttcttctttttatacagttatagataaaccggctgcagccgattattttttctatttgcacacgttgttctgcatttggatagattcgtatttttactgcccggtttattttcctcaccttattcctatatatgaatgatttcaattatcttttacgaacaatatgttctctttttattataatacaatccagtcaccagaacaagtgtttcttctttttatttataagattcttttgatcatttatgagcatttatgctcaaatctacaattcatctcactacctgaagaggtaggagaattcttgttatatattatgttaaatattattccataaatgcaaaaacaccacctgccagtctccgcgaccctccaggtgatgttttctaatttacatattcaacttctcacaccattatagtgtattttctttattcaaccgttacgctctttgcaaggtttctcggcttatctacatcaagacccttggcaacacttacatagtatcccagcaactgcagtggaatgactgcaagggatgttgcaaaatgcggatctgtcttcggcatatatacggtgaagtccgcagtatcttcgatattataatttccaaatgtagtcagacccatcaggtaagcgccacggctcttgcactctaccatgttgctgactgttttttcatacagggatggctgagtgagaacgccgatcaccagtgtaccgtcttcgatcagggaaatcgtaccatgtttcaattcacctgctgcgtatgcctcagaatgaatgtagctgatctctttcatcttcaggctgccttccagacagattgcataatcaatgccacgaccgatgaagaatacgtctttagcgtttgcctgttttgatgcaaaccactgaatacgctccttgtcatcaatgattctctggatcttatccggcagagtttcaagttctttaatatatgccgcgtactgttcctcggaaatcgtaccttttacttttgcaaactggatagccagcgcataggacgcaatcagctgtgtactgtatgcctttgtggttgctacggaaatctccggaccagcaagtgtatagaagacattgtctgcttcacgtgcaatagaggaaccaaccacattcacaatgccaagtgtacggatgttgttttctttgcagagacgcagtgctgcaagactgtctgcagtctcaccggactggctgataatgattgccagcgctttcggattcagaatcggatttctgtaacggaattcggatgccagctcaacacgaaccggaacacgaaccatatcttcaaatacatactgtgcagccattcccacatgatatgcagaaccacatgcaataatataaatctggtcaatgtcctgaatattttcatctgtaagtccgatttcagaaagatcgatctgtccgtctttcacaacagaactcaaagtgtcctgaactgctttcggctgctcgtggatctctttcatcatgaaatgctcgaaaccggctttttctgctgcttctgcatcccactcgattgttttcatctgtttctggatttcttcgccatccaggttatagaatgtgatctcacctttacgaacgcgagccatctccaggtttccgatataatatacatttcttgtatatttcagaatagccggaacatcagatgcaacgtaagactctccatcagaaacacccagaatcatcgggctgtctttacgagctacatagatttcttccggatagtctttaaacatgatcgcaagtgcgtaagaaccacggatacgaaccattgcatgattgattgcatcgaccggtgttccctcgtatttcttgtaataataatccaccagtttcacagcaacttctgtatcggtctcagaataaaatgcataacctttgcgaagaagtttatccttcagctcctgatagttctcaatgattccgttatgaactgcaacaacatttccatcatcacttacatgtgggtgtgcattgttctcagatggttcgccgtgagttgcccatctggtatgtccgataccacatgtacccggaacagattctccgtcatttgtcttctcggataaaaccttcagacgtcctttcgccttaatgacttctgtctcaccttcgccatcacgaaccgcaatacccgcagaatcatatccacgatattccaacttagaaaggccatccagaaggatcggggctgcctgatgacatcctgtaaaaccaactattccacacataaatatttctcctcttctcttcttaactttatataaagcaaactataatgtaaaaaataagcataattttataaaagccaaattttggtctatcataacacaaaaactgcaggagttcaagtttatctgcaaatgcctgcaattaccatatcgaatggcagtcatctcataataatatatgccgtgtagatcagatacattgccaccatggcaataccttcgtttcttgtgatcttcctgtcacttctggcaaaaaaacagactacaacagaaaagccgacaaggaccagaatatcgatcacattttcactgatcagcgacaccggactgatagcagatgcaataccaaggaccatcagaatattaaatatattcgatccgactgcatttcccactgccatatcaacttcatttttgcgtgccgcaaccacagaagtaaccagttcaggaagtgacgttccaatcgaaacgattgtcagtcccacaagagtctgactcattcccagatctattgcgatcctgcttgctgcatcaactgtcatatccccaccaaatgcaattgccactgcaccaccaacaatgcagagaatactctttggataagacaacagtttcagttctccatcttccagctcctcaactgcttcgatctcaacttttttcccttcggcccttgctttcattgcagtccgaatcatatagaaaatatatcccgcaaatgcgcccagaaaaacagctccgtccaaatggcccagtgtcataccatgcgcatccccccatgcaagatatccaagtcccagaaggagcagcgcacagataacagaaagcgggatatccctcgcgatcgtatccttctgcaccatgatcggtgtcattatcgcacaagcacctatcacaaacatcagattaaaaatattagatccgactacattactgactgcaagttcattattgtgcaccaatgatgcagtcacactgactgcagtttccggaagggatgttcccattgcaacgattgtcagaccgataatgatcgaaggaactttcagtttctttgcaatgctggaacttccctcaacaaaaaaatctgctcctttgatcaggaacacaaaacctatgatcaaaaacacgattaccaatgcaaacggtgcattatttatatattgttccatgaatgactcctttcattgtagtttacactacaaaatgttatacttttgctgaacattatcgcacataaagttaaggagaacaagacatgcagataacaaaacctactttttataaagaattttcctgtatcgcaggtgcctgtcccgatacctgctgtgccggatggcaaatcatgatcgatgaaaaaagcctccagaaataccgtagattcaaaggtccttttcgaaacagacttcacaatgacatcgactggaaagaacattttttctgtcagtatgacaaacgctgtgcatttctgaatgaagacaatctctgcgatatctacagcgaagccggtaaagatatgttatgcgacacctgtcgaaaatatccacgtcacattgaagaatttgaagggctgcgtgaatactccctgtccctctcctgcccggaagccgcgagaatttttttgtcccacaaagaaaaaatcacattcttcaccagagaagtcgcagcaccggaagaaacttacgatgacttcgattattttctttttaccgctttgatggacaccagagattatcttttctccgtgattcaggatcgctccataccagtcagattacgccgtcagaaacttctggcatgtgcacatgatttccagctcagtctggacaaaaatgagctgttccagtgggaagatatccgcggtcggcatcaaaaatccggatatggcgagaaatttctgaataagatccagaaatggaatgacgaatgccaggtatcttctgaacagcccagcaaagattctacctctgctagagcctcactgcttgctctaagcaaacagatctggcgcacggttatcccacagatggaggttcttcgcccaggctggcatacatatcttcggaaaacgctcgttccactctatggctcctgccaaaatgatacggaactcacagaaatttatgccgccttcgcacacgattatccagactggacggttcacgaagaacagcttctcctctactggatctatacctacttctgtggggctgtttatgacgatcagatctttgccaaagccaaaatggctgtcatctgcaccttcatgatccacgaacttgccgtaggaacctggttaaaaaatgaccgtcattttacctttgaagatatgatttccatctgctatcgattctcaagagaacttgaacactccgatccgaatctcaatgaaatggaacgcctgatggatgaagaagatgtgtttgatttcagaaatttactcacaatataaaagataagcaggcggccgtaaaggtctcctgcttatcttttatggaattattctcccaaaaactgctcaactacctgtctgatcagagtcctctgttcaggtgtaagcttctcaatcttctccatcaactcccgcacttcccgcggagcttctgaatcctcattaaaaaaatcacccggtgtgatctgcagatactcacagatactgaaaaatccctgcatcgatggcagtgctttgccattttcaatccgattaatataactcgggttctgtcccagcgcaaggctcatttcacgagctgagttttgccccccccgattcgtaaatcacttattctcttaccaaaatttacctttgtaatcatttgtttctccatcaacccaacatcacttcgatgctgctgtccagttcattatatgtcaattcctgatgaatttccttcaagatctcatcgccggcgatcagccgctcaatctcatcacgagtctgagtatccgccttatcaataaatctgcgcaccattgcatttccacttgtgttagaccagtaatcctgtggcagcgcattcggatctgctcttaaaagatcacagtaattgatcacatcccacggacaatacacttccacatttccaaagcgatatccgtcataccattccttcacttctgcataatgtccagataatccatagtattccagcatgccttttacttctgtatccgtaaatccaaaatattcatcaaatctcacatccgtaagcgtcagcactttcagattattaagaccagtaaagatactttccttcgaaattctcagacatcctgtcagcacagcaaaatacagattcggattcgtctttaatgcattaccaaacatatttctgagcaaagacaccatctcatcataatatccatactgaaatgccttatccagaggcacatcgtattcatcaatcagaagaataacctgcttgtcataatgtttatgaagcaacaatgataatctcagaagagctttctccattgccgtatcagacatcagaaaatctcctgtttcaccaaccctgagcagtgctttataagattctatttcttcatttgtaagcttactgctttgtgtaaggaaataaaatctgccagcctcttcgcccaaaatatccttcaaggcttttttcgctgcttcaaaatccagtccttccacactctttaaactgatagaaatcactgggaactgtcccatatatttctcacaaagttctttcctctccgaaatcttcaagcctttgaacaatgcaggactagcgccaatttcaaaaaaagccttcatcatactcatatttaaggatttaccaaaacgcctcggacgggtaaaaagattcacttcactcctgttctgtatcagatcttcgatcatcccagttttatccacataatagaattcttccctgtccattttttcaaaaatatctattcctattggcagttttttctttcccgtcattccagcacctccacaagccaagaaaaaaagttccacgtaaccatcatttataaaaataatgatatcatgaaaccatttttacgtaaagcgagttttcccgttctgtattttctatttctgccaggcgcccttcttcatacatcaactgatcatgttcaaaactcttcatataccttaccattgactctattaaaatcctctttttcggccttgcaaaatatcattttgtccacctttttactcatgcaactccaacggcaatccgtccgggtcatgaaagaaagtcatcttcttgccggtataatcatcaacccgaatcggctcacattctatgcctaattccctcagctctttcactgtctgttccacactgtctacgcagaacgcaagatggcgtagaccacaggcttctggatagttcacacgcttcggaggattttcctcagcgaaaatctccagttctgtatattcattgacacgaagatccagcttccaatccttacgctctgggcggtagttttctctgatgacagagaagcccagcttgttcacatagaaatccttagcaactttgtagtcagatacgataattgcaatatgatgtatttttaataagttcatcttcccttcactccgtttcttttattttcgttataaactatatagcagccctcaaaatataccgtgtgaactcctgaagttcagtttgtccacacggcattatatccctcagcatatggatgacaaagatctcaggtttattgatgatcttcttccatggtcgcccagaatccagaaagaatgtccaagccgatacaaaaaaacttgatttttcaatgtgcatttctcacaccgatccctcactcttcactaccgacctaaccgtcttcaacaaaatcctgcagtccaacccaatcgaccagttctcgatatactcggtatccagcttcacgacttcctcaaaatccgtaatatcactcctgccgcttgcctgccacattcctgtgataccaggtttaattgacatacggcttctgtgatgcagctcatactgttcccattcatcgactgtcggtggtctggttcctaccaggctcatatcacctccttatgtcaactcaggaacaactttttttcaaaaatatctcataaagcacagtattatcaacttaccctcaaaataagcacaaaaaaagaacccctgatttctcagaagtcccaaattcttcgattctatgtctactctatttctccaaattgcactatcctagcctgattcaaattaaattccaccagattatattctggataatgcgttcctgctattcgatacgtgtcattttcattccactcacaaactctccagattatcctcagcatttgaatactgcaaattttaaaatcccagtctttaggattatatttaggcacacgaaaacactccgcttcttttcggctgacagactgaactgctaaagttcttttctccgggttaaataagaagcgaatatacctcggatcacccaattcttttatcgttgatcgaaatattcgtattattccttttttttggcacagagatacccctgtgatatttactgtggttttcggcatctgcactcctcccttccaaatgagcgcactttctcctatcaccttgttgctgaaaattctatatagccgtctgttaaattagtttccagtgcctttttatgttcttctactgataagccaaaagaatccttccaatctttaggataaaatggtattctattcaactttctcgccacttttgctgctatctcttcctgattctgttccggtgtctgatctgtttctgcagtaactaattcttcctttttctccactgaatctggatttgcttttttctttctttttgtatccatgaatatctctgtttctaacaaatcaaaaatatacatagtttcatcttcatgtgttattttatgccccaaaatcttatatcggcagtctgtattccattccatcatgtcatacatcattgctgaaaataatttatttgacatttttctactttttctcttatcaggtttttcaatacaccatctcaaagcatctttgtcgttttcttcgcatttccgcactaccattcgcttattatcttggttaacaagaatctgtatgtaaactgcatcctctaaaccggcaatgcaggcagtattaaatgtcacactatctcttcggattacaacggctggctcccgtaaatgtgcaaaaagttcccttcttacaacctggtaaccctcataactaaaatcctgtgccagttccagtgccttctgatctatgttttctgtattctcaatagtttgatttatcatcatttcactcatactgcacacctcatcttttctatcatgttctgtgcttcttcattcagcttatccaataaattttctgatataggttccaaaccttctactattttagctggacgcagcacatcccaatttccacaatacttaactctatgtaaaagaacaacatcttccgggctatcgccaaaatgattctgccactgcttcgggaaaagtgttctgacaatcttctttgtcttattttcagatatatctactatattctcttccgtttcagtcgtatctgtatcaggtaaattctcttgaattatctcatgtttaatcacttctggttcttccaggtcaaacaataagatctgttcgttatcttcctttgaatattgacctctaaaacgatatttacactcattattccagtccattaattcaaatagtggttctgaaaatccccggcagcttttaggcaggactgcccatttaccatttcgtatcgttccccattttacggcattgatgttatctttatcgcagggtcttacagcgatacatctttctatcgaattaaaaagaatttctacatattccacatcttcaaatttcttcaaacaggcagtattaaaggtaatacgtccttctgagattgtcatggctggattcaaccttgtagaaaagaactgtgcccgaacaatctcgtatccagataaatcaaatcctccgtcttgcttttcttcttttgattcttcaatatcttgtatactattctgatcagaatacacgctctgacttgcttttttataatcttctactgtaaatcctgtccaagaccgattaaccgacacaaaaccttttaacgctccaccatctactaccttgagattaggaaatggaaagccttttttcgcatactttgttactgtcaacatcttctgtgccgcattataaatatccctgtcaacaatagcctcatggtgatctgtttgtcggtactggtttcgatcatgacgattcttttttgatttatgatcaagataattaggcgtaaatgtctttctggaaagtacatctccacaatatctctcatttttcaataaacttcccacagtaccacttgaccatttagtatttcctagtttcgttttccgctttaattgcatcagtatttctgcaatttccgcagttggaaaaccgttaagaaacaaataatagcataaacgcactgtttctgcctcttctttattaattaccagattaccatcctcatccacatcatatcccaataattttggtgtaagaaatatgcccctggaaaaacgttgttctatggaaatattcataatctcacttttcgtatgagactcttcctgtgcagctgcggataatactgccagcatcatttcactggtattatccaatgtgtaaatatgttctgtttcaaaaaacacacccacttttggtcgcatatttccaagttcacgaacctttgcaatacaatccactatatttcttgcaaatctggagacacttttggtaacaatcagatctatttttccagctttacaatcttctatcatccgattgaactcgtctctatgctgtaaagatgtaccggatattccttcatcagcataaattcctaccagctcccatccttgatgttctttaatcatatcttcataatgattcttctgcagctcataagaagaagtctgattaacatcatcagtagaaacacggcaataggcacaaacccttttctctgctgtatcctcaaacaacttttctcttggttttgccggaatgaattccaattcatttcggtcaacacccttatatctttcacgaatcttattcttttgttcttcctgtttctttatttctttttcatatccgctcacctgatgcatcactcccatttaacttccaataccatttatctcccaatttataggatataatccccatatctttttttgcctgctccacagtacgtttaccaataccatttgcacgcattttatcaaatatatctgcacatgccatatctgttccacttagcagtaattgcagataatcctttgctttgtccagtttactatctgtttttgatttatgagacaaaagatcttctacttcatattcctcctgccctatccagcgaaatcctgaattcggatgtagttcaaatacatatgcctttccttctggtgccagattattttttatctgaagcattacacgataatgcggaatatttctatcccttcctactaataaaatactccttgctactgcagctatatctatacttccaagtcctcgatatataccttttgtccgattgcttttattcatatgtccaatcagcacaactgcacatccagtccgctctgcaacttttgcaagatttgtaagaacagaacgcaccgaatttgtacgttgcatttcactatccattctcaagtaggcttgaagtggatcaataaccaataatttcgcctgtgtacctttaatcgcttgtgccaatcttgtgtcatttagtaatattggttcttcatccggctgttccaaaaatgcaattctactacaatctgcacctgccgcttccaatcgtggcttgattgtatcttcaattccatcttctgccgcctgataaattacgtttcccggtattttatctccgcttccatctggcatagcttttccagttgtaataagtgccgcaagctgcatcatcatggtcgatttgccttctcctggatctccttgcaatatcgttatctttccatagggaatatacggataccataaccaatcaacttcttttgatgacactgcattataatatgtaattctataatcattttgttccttttcattttgagccatctataacccttccagctttttatttttctccgtcatatctgcaaccagttctgtaattgtttgtatttcttttggtgtaagaccagatacgtcaaccgttcttttactttcacaccccagcagatagtcggtactcactctataaattgtagctaatctgaccaaaatttcataagaaggctgtctgacatcattttcataggaacacattgtatttttatttactccaaccaagcttgctacctgatcctgccgcaagcgattgttttgtcttaattgctttaatctatttcctaatgattccatcatgtgcatcttacctttctatgcactatgaaaatttttgattttacagtattttagtatattctatcaatttatagttctcgtttggggaactgcggttcctctttcgagaaccagactaatttccacttaacaatgctttataatatttttaatccataaatactgctttctctttttatgtttccaattatatattatctagtgaatttattcactatatttttgcattttcccctacttataattaaacaatcaggaaataaattagaagggcggggacaatgtgattgattatagtccgttatggattacaatggaaaaacgaaatatatctcaatattatctcgtcaacaatggcatcgactaccgaactatgcagcaactccggaataaccagaatattaccgcatcaaccatcgaaaaactttgccggatcttatcttgtaccccaaatgacattttaacttttacagatgatgatatacatgataaataactgtcggaaccgatgcatccggcagttttattttgcaacattgcggtcttgcggtgttgcggtcttgacgaaaaatagtccaaaacacaaagagcgtagatggaattttcatatcctctacgccctttgttctctttttcaattttctattattctgtggttattactttttcaatttcttttgcaatattctcttcatttttaatatcttgttcgataagttctgcgatattttctaatgcttttgcaatatcttcataacagtattctatactgtcatttattccgttactagcacatccatcttcatcaaaatcaatatatcctatcgtaagacttacacgtccttttcctagtatttctccatcgttatcttttattgacaactcaatatcttcttgatctccagccgtcgctatacctgaaaactccccaatattaaactgatacttttctaaaccattttgtatttctattgtatctccatatttaaaattatctggcagacctttttgttcactaagtttatacaatctttcatatgattgatccacccagcaaataatttcatccttttcttgagcagttatagcatttaaatcagccgggactggaaatcctgtaatatcttttaaatttgatgtcagttgcttcacaatctcctttgattctgtatctttaatgaccgacaataactcatcatacattgctgctatagtatcatatttttgatataattcattaattctttcaaatttcccaataatctcattcataaatgatgagtctactaaatcatcctctaaataatcggcatacttatccaacgaatataatcctaaatcttctctatcctgatttattatatccattgcatcataaagctcctcatcttctctcacttcaaaacgttcatataatgtatctccatttaaaattactttaaatgggataattcgtagattattttctttacgatttaattcaattcttattccaaatcttgcccgatgtctttcaatatttgttcttgcttgtaaaaaataaaaagttcttgtttcagcatcccatgcggcattatcataatcctcataagaacattctacctctacatccgcagtgcataataatgtagccaacgctatttcatctgtaatttcatcaatagttcttacatgaaaattgatattcttaatagaggtgacctcaaaatcagtataattaaatccactttctatgccatccttgtcatatgacaaaccatggacttcaacgcactcctcgttttttatagcatctcgaatttcaaaagtatagtttacaatcaaagaattaatttcttgaagaactgccgtatattctttttcttgactattcattgtgttatataattcgcctaatgatgtaaaaaaaacatgattttccgaacgaccgcaggctttcttgaatcttttatcattgcttattatagcaattattttatcttttccgaatctttctcgaatctgatttgcaataaacgcatccggaaattcttttctttttttctcattattttcaaatgggggcttaatctcaaagtaatcatcaactatctcttttaaatctactaatgacaaatccataatttcaggctttaaactttccaaaaatttattccaaacacctaaacacttttcttgatactctatcttatttagaaacaatgcgtcaggttttattccaacttgttccaaaagcccttctgaagcgatacttaacgctttttttcgtagttcccgaaatgctgagcatatactatcacttgattttataacatgcttttcaacttctttgataacaatattgctcaatacaatttttatcttaccagcttcaacataattaacaagcaagcctaatgtactctctttactgaagtctaacttattagcatcaaaaatattcgtatctaatgtaacatataatggatatttaatcataatccttcccccatgatattcgttttttcatttctacgccgattataaaaaacaaaaaactttcttttcagttatattaacacaaaaaagcagcactgtatattttttatatacaatactgccatattaaaaaactatcctataaattattctcaaacatcgacagccccgccatcagcatcccttcatccatatccagtccatcgctctgttcttcttctatcactttcccggcatcttcttcaataactacactcttttttatctgctgtataaaatccgtatcctgcaacaactgctgctttaattcctctacactgacatttgcattattataggaagaaacaggtgtattttctttatgcagccacgcataaaccagttctgtaatcagtgctgttttgcaccttttctgtgatttcagataccttccgatttctctctgccgttcattatcttcattaaatatcagtacaacccgtatctctcccacacattacaccccctgtcttttctggatgtgtaatgctgtcattttctcatatcctaccgcatttgcccggatgtcctcgataaactctatatatttaaaatctgaagatttttcaatctgctgtttcagaagcaagctgcctccaccaagaaatactgccggattagttcggaaatctggtacatacgcatggagtttattgataatcctttgcatccagtctcctgccattttctgaatctctcttaccacctcttcatccagaattgttgcttcctgcattaatacctgctctacatctgaggattccagatgaataccgtaattctgctggatggaattagaaatttctgaacggagaatcgccattccagatctgtcactgacacgaactgacaaatccggctgtccttttctgattaccagtaaatctacagttccgtctccaatatcaatgcagttgaccgtccggtactgacgaaacaggcttgctttatagcacatgactgccgcaaaattctgcggacttaccaaaacatctttcaggtaacaatttaccggctttccattgaatcgaaaagaaatcccatgttttgaatgttccgtaaaatattttttgaatcccggagcctgctgtccaaagtctgcaggcggcaatccaactcccagtacaatatctttgccggataaagtgattcctctttcctttgcttccaaagccagtgaaaataaggtcaatataaagtaatcttcatccactgtcttatctgctttgaatggcatccttgtttctgataacgtataatacacaccgttgtattccagaatatcctcattcataaatcgtcctggttcagaagtatatcttaccagaccacatggaaagtttacatgtacccctttcatatttccatttccatgatcgattcccataataatttctgccatatcctattccatcctttcctgatcatcttatacttaactgttacttaacttcaaaccgttttacttttttcatatttcttatgacagttatgtataagtttacttgtacttttgtgtctattgtgtaagttatatgttacttttgtatctgttatcattatatatgtcacatttgtatctgtcaatatatttttcaaaacttttgtggcactttcatttaaaaatgtgatatacttttgctattggaggactttgcctatgaatacaggagaaataatcaagtattttcgtctggctcgtaacatgacacaggaacaacttgcacaggacgctgaaatcagtttcagtacactccgcaagtacgaagccaatgaacgtaatccgaaatatgaacagctttcaaaaattgctgatgcgttaggtatcagtgtgaatctctttatggattttgacattcagtctgtatccgatctgttttctattctgtttaaaatggaaggacaggcagatttagaaattgcaacctcaaaggatttagcggatctatctgaagatgctctttttcttcattttaaaaatggatacatcaatcacatattaggcaattaccatgcttctgttgaaagtatccaggacatggatgctcaatatcgtgaaaaagctctatcagaaatccagaacagattattagatgacaatagcagtatccatactgacagtcctgctttatctgcagattccggtaaacctgcactttctctttcttctgctgatcagacctggtttgaattatcctctgactgctctgatgaagaaaaagaacaaatgataaaagctgctgcctttataaaaagctgtctgcgacattccgataaataaatctttgcacaaaaaagacagatgtggaaatatttatttacctgcatctgtctctttctatcctatgctattttctactcatgaatttccaatggaagtccatctggatcatggaaaaatgtcattttctttccggtataatcatctaggcgtaccggctctgtttcaattccttttccattcaattcttttactgtatcatctacactctcaactttaaatgccagatggcgtaatcccaatgcttctggataatttacacgagctggagcattttttatgataaaaagttctatttcctgcgacccacacgccagatcaatcttgtaatcatcacgttcttttcgataattttctctgatcaccttaaatccaagcagatccacataaaaatgttttgatttttcataatcacttccaatgattgcaatatgatgaatggtatcgaacataactctctcctccgtttttcatatgttgatatatatttttctcacattttatcacagtaacgatatatgtggaatagtcatttcatatccatttacttttttaacttttctgccagttcaaaccaaaactccaattcaacaacatctttttctccatgttttctgctgccaatacctacccagtccgcttcatttaacagattcttcattgtttccttatcttccagtgctgattcaccatcactcagcaaccagatatatcccgtctgcattttaataagtgcagacatgtctggaaatgtctgaatcttaatattacatcctgagatttttgaaaactgtattgcccgttctgacagatatataaacctctgatattttacaggattgataatctgatattcttctttctttttacgctctgctttttccataattgttcttgcttcctggaataatttttgatgttctttttccctttcctctaccgaaagtgactgttcatgctcatcctgttccttcttcatctgctcatacatttctgtctgttcatcatagtaaaacttttcaatattcacttatataactctcctcccacatacacccatcaatcaattcttacattatccgactttattttcctttattttacatatccctcgatcaaattatatctcttatggtgaagatgtccaccatattttttattttattcgacaattataattgaaactaatggtattttatgccaaaaagcaaagaaaggcggggataccttgattgattatagtccattatgggaaaccatgaaacaacgccacatttcccaatatgccctgattaacaaaggaattgacaaacacaccctcgatcagcttcggaaaaatcagaacattactatccttaccgttgaaaaactgtgtaatattcttaactgtacacccaatgatgtgttcgcttttaaggatgaaaaagatttgtaataccgtcatagtatagcaatattcctatggcggtatttctgtatatggaagggcagagaaaaaccgcaggtgaaaattcctgcggtttctattttctaagctgtatcggtattaaattgccttacaattatgcacttttcttctctgaagctatcttttcgacttcctctatggttagttctgtgtatgctgcaatatcttcataactgagtttgccaccatccagcattaaacgggctatatggactgctttcatttttgccgcttcatttctcatatcttccatcactttacacattaccgccacccctttctcatcttctttaaaataatgcacacggtcagccagaacttcataatacatatctttcgcatttgtacaggcaaaatcacgcataagttttcccagtgctgtttcatcctttatctgggaattcacatatatgatatataatatataatattacgcatgatttctgcaatatttccactgcatatattcatcttcggaaatcattccctgctttttctttcctctaatagttccccactgataaaggaattcattgattttcttattctgcagattgatcacgacctcgcctgtccttccgtttctttccagtttcatttctggaaagtaatcttccagcacaagaagcctatataccatatcttcttccctatagcctgtcggaatggaaatgtttctcggatctacatcaaggactactgccattttattcagcatttcctttctcggtgttctattgtcagtttcatattgtgccattcttggacttgcactttcttctccgattccaatcgcaattccaagttctttctgtgtcattcctctaaacttccggattcttttaatattttcgcctgtactcatatcctgcttttctcctttcgcagcaaacagcttattggaaatgcgattacataccatactgccctgattgcaattccaatcgcaataataaaaccaaatacagctccgattatcgcacacaaagctaccattcctatcgttccagataaatcccagtgccacggaatgataataaacatatatgggattcctaccggaacaccatataccagcatcagccggaaccagtcaatttctccatctaccatatacagatactttccaagccatccgatcaatgccaacacagttatcatcaatacccctttatacataaaatttttaaatgtcatgcacccttcgccccttccatatattctgagatcaccttttgtaaaacatcatcaaatcttaaaattacttcaatccgttttttatcatacacatacaccgtatcaatcatcgtatctataatctctttggtcagctttcctctttctatctgtacctccaactgttggactgctgttcttatccggcttctgtatcgttcttcttcaatgatcacactggcaagtgctttttgttcggattgtattttttcgattttttctgtcagttgtttcttcactgttatatatttttctctgctaagtacaccttctgcataagcttcatactgatgaatacgttcattttttaatttttccagttccgattccaacaccctttgttgttttttccctgtaaaactattatccgtatatttttcttcggattctctttgcactgaatccaatatccttagtatcctttttaaggaataccagatatgcccctctatcacagataccggatatgcatcttccggacaatgagaatatcttcctgcctgaactttatggggacaatatatttttggatgaataccaccatctgtataagctaaggatctgtggcagtttccacaccgcacttttcctttcagaaggaagtctttcgcaccacgatattctggctttgtcataaacataatagatgcacttgccacttcatactcttcttccgtaatgattgccggattaatattctttcggataacgacatctcgttctgctgtctttcttgttactttacttccaaccgctacggtatgccgccttcccataactaaagcacctgtgtactcaaatcttccaagaattgtacggatcattccggtatcccaaacaacttccttatctggcattttataattcccctgccgaagcaatccgttcatctgattatattttccaggtgtcggcaccttctgctcgttcatgtaatagcagatctgagaagtattgcagccttccattgctttatcaaatatcatgcggacatatttacctgctaccggatctattttccagcatccatgctcttcatcttttaaataaccaaatggaggtttcgagcctgtccattttccattcttccatttcaccttcaaggcactctttaattttttggatatatccttgctgtaaagattgttgacaagattattgattgccatatctaatcccatcgtttttcctatgtactctttactgtcataattattgtttaatgaaataaagcggattcccaggagtgggaacacttgctccagataatctccaactccaatataatctctaccaaatcgtgaaaagtcttttacaatgacggtatctatttttcctgccttcgcatcttctatcattttcttaaatgccggacgttcaaaattcgttccggaatacccatcatccacatattctatgtattcatcactcatgtcctctctgtcagtgataaaattgacaagaagtgatctctggttgtcaatgctgttgctttcatctttattttctttccctaaatctccatctgctatagagagtcttaaatacaatccattagccaatctgaacaccttccatttcttctgctatctgctggaattcatccttacatttgaagcacacatggatactcccatttgcatatacttctatatattccaccagttcttgtacaagtgcctcattatattctcttttatccagatatttttccatatgatttaccatatccatatatcggtttgctttcttttccaagatcctttgattttgttcttgtacctgaagctcttcccggagattttggagttcccctatatagcgttccttcatcatatcaaaatcatctttatccacaatgccagctacataatcttcatatagtcttgtattgcgttcttctgtttgtgcgatcttacgctccaatgtccttaccttttccgctgctttataaaaaatattattttcttttgttgcacttttcattttctgcaaaagcaattttctgtcacacatactcttgatcaaaatctggatctgatccatcacaaggatcttgagtaagtttccttctatcaaatttctggaacactgttcattcccacaatagtaatcgcttcccattttttcattggttgtataattatgtgtatatcgtctgaaatacataacgtttccacactcgccacaccggaccattcccggaaaactatcctgatatttttctctgtccttcatacatctggactggcgtttcttcgttatcttatgaatctcttctctgctttcctgtaattcctcataatcatccctcgcaaccagcggagtgtgcatatctttctgcacatcccactcttctggtactgtatgatactgtttcactcctttgtacaaagactgtttcaatttccctgtgacaatatctcctgtataggttggattttctaatatttttctgacagttcctccattccactttgtctcctcaagtggcactcttgctatctttctattttctttttgtccaggtgtcgcaactcccaacaagttcagcctgtcagcaatttctcttttactgactcccagcaatgtccattggaatatcatacgcacaaccggggcaaccgtttcatctacgacctgtcttgttttatcctcagaacggacataaccaaatgcaaccttagataacgtaatatttccgttccgcttttgtgcttcctttgccgccaggatttttttagacatatcctttgcatacatggcatttaccatgtttttgatgggaacacttatattttccctgtcctcctttctggagctatcataatcatccgtaatcgcaataaagcgtacatttaactttggcaatatagtctccaggtaatatcctgtttccagatagtctctgccgaatctggacaaatcttttacaacgatacattgcaccttgccagaacgaacatcttccatcaatctcataaatccgggacgttcaaaatttgtgcctgtaaatccattatcaatgtatacctcttccagtctcagatccggatgctcttctataaatctttctacaagcatctgctgcacaactaatgtttcatccgtttcatttcctccgttttcaacagacagacgaatatacgcagccgtatccagtaagttttcttttttgacaaccgtttgtatattagattctacgtttctgttttttctgctctttcttgccatccctattcctccatccattctgctggaaagtattttttccattcctgcttggataaacatacctgcacttctttaaaatctcttatcaatactttctcaatccatttattgatatgctctggctgtagttctttcggaagattctctttcttaaaagtctctaaccattcatttttattgctatatgccttttctataacggatacctctttcataagttcactgaaatctccatcatacatacgaagctgatcccgtatttcttcttttcccaccagatattcttcttcattgatttttcctgtctggtagttctgatataatggaatacgctctttttccacttgctccatctcttcaaagattgtccacgctctttgtgaatactgcttcaaccattcatatttttctgattctgcttctctggctgacagtttcttttttatctgttctgccagttccatttctctttgtatggcttttcttacttcagcaatcacggtttcaaaagaaatgtaggtacttttatctcttggaagctgattcgtcccacttgcgaaaagaaaaaccgtttcccctgttttaaaatttctctgtgatatttttcttcctgtctcggcatcaaatatcttttttacaaataatccatttttacttggtcttgtttttcttggcttctttctcttatcgagaatctcctgcactttttcaaacatgccttcttccaaaataggagctataggaagtgtacaaatttttttgttgatcgtcttttgccagtaaccagcatacgctgtgcatctaaggattctctttacagagcagaataaccatttattgtcatatgtcggccataccttatgaccgactcgtgcattatgcaccatcggagattctattccactgtcatttaaaattttcactatatttgctatcggcataccatctaataccatctgaaagatctcccgcacaacaactgccgcttcttcatcaataagcaattccctgcggtcatcagaaagaatgtatccatacttttcatcatgcacggtataaagtccctccagctgttctctgactgcatactctctcatgccttttaactgaactgccgcatacctagctttctttatatattcatataattcttctttcgtttttccaatgctgataaattcgtcctgtacaactgcaaaatgtattcctgccgggacaaatgtttttactaagacatcatctgcacaggatattgtccttccgcatctgtcaatgctgtctacaactaccatatcaaatttgcggttgatcccatcttttgtcagttcttcaaaaactgtgttctcttctgtatctttttttctgtcgcaatactttgcagataatgtccatccctgttttttcaagtattcctgtatatgctggtcctgctgttttataatatccgccggaatctttccgtcctctttacaggaagtcgttctggtataacttacgcaccgcatacaaattctcctttccgttcctgccgctcacgtatgatctgcactgcttctatcatttcctgcatctcgtcactatacttgaactgaatttcaatctgctccttgctgtatacaatgatctgctctatcaatgtaacaactgctttccggtcaaggctttggatatttttatattttttgaaatcctctatccatggatgcatccgtttttcttccgcagataacttttctttcttctcttccgcttcctgtttcgccttttctgctttctgcatcttctctgtgaatctctgattatattcatggtactcttctctgctgacaataccgtctaccatatcctgatacaatctcgcctttaagtctttatatctttccacttcctcataaagtgccattaactgctgttctaaagaccggctctccactttcttgtaagtatccattccatttttcttgatgatctcttctacttcggtcaataatgcgatctgcttttttacagaatccagaactacatcataaatcattttttcactgatcagatgggaactgcatccctctttgttcttataagtggagcaatgataataacagtatttttttcctttcttcgttgtgcttcgcttgaccatgttctcaccacagtccccacaacgtacaaatccagaaaacaaataaacagattttcttttcggagcgatccgggtatctatttccaacagactttgtacatattgaaaactctcttctggaatgattgcttcatgtgtattttctactcgtatccagttttctcttgcaataggagaacttttcttcaccttataattgatctttcggtttttgccctgaaccattgtgcctatgtaaagttcattctgcaaaatacggttgatggaagtgactgcccatttaggatcagaaccggaacggaatccgctgttataattcatcccccggcttctcttatattccaatggcggcaaaactcccatttcatttaactgagctgctattctttgtgaactgtacccatctattttcagattaaaaataagccgtacaatatctgccgcatattcatcaacaataagatggttcttatcttctggatcttttaagtatccataagctgcaaagttaccaataaactgcccgtttttcctttttacatctaactgacttcggattttaattgagatgtccctgcaataagcatcattgataagattcttaaacggaacaatgatctgatctgcatcatccgatcctgcagcactatcataatggtctgtgattgcgatgaaccgtacacccataaatggaaagatcttttccagataccttcctgtttcaatgtagtttcttcctaatctggataaatcttttacgatgatacagttgatcttcttccttttcacatccccaagcatcctttggaatgccggacggtcaaagttcgttccactgtatccatcgtcgatatattcctcgaccagctggatctctttgtgctgttttacaaaatcgttaatgagacttctttgattgcggatactgtcactctccagtttgtctccatcctctctggataaccggagataatccgctgctaaaatagacttttgattgagatacataaagccatcaacctcctactttactcgctctgtggcggtgtaaaccaagaaattcacggctccttgaatgcttttaaattttgacccacatccatattaacataacttctggattactaccatacctttttctttcttttttcgattatttttttctggacgatttttcttttacatggagatacatctgctcaggctttcttccaacgagcattttcctgcaaagctgatcttcacaactaccccatgtgatttatagcaatacggatttttaatctgcttgatataatctacaattctttctgcctgcggtaattcttcatgaatctccacatcatccagctctactaacgtacttctatctacggtacggatgtccactgctgccatttcctgcaattcttccagtgtaggcatttctatttttttcatctggctacctcctgtgatctctctttttctactaatcacagctggcagagggcaaaatgtcagatgaattttcactttttttatttttttatatttttacctgtctttttgatgtctcccacgcatgattatgggaagggattctctcttagagcaagtttcgcaatgtagcacaataacccctttcggggttactggccacttgcaacttgatggggatttcgtttccccataccctcgaccgcaatcaaagatatgcgtattggttcccattgtcatggtcacagcgtgatgattcttcatcacttgctttcacagcaagctgtaatttttctttcccgtgcggagcctttatgcagaaaggagcattgaatgacaagaccaaaaaaagatgaatcacttaccaagaccaaagacgttcacctgcgtatgagcgagacggaatatgagatacttttggaaagagccactgcatccaacatgactgtttctgattttatacgcaatgctttggacaagcagaatgttattatcaaatatgagattattgcagatgtcaaagaaataaaaaagctgattggtgaattgggtaagataggaagcaacctcaatcagattgcccgatattttaatcaaggtggaattatctcctcagaaatgagaacagaaattaaaaaatctctccgggatatttatgagatgaaatatgaagtaatgggaatggcaggtggtttccgtggcagtgattaaacatatcgcaagcaaaaatgctgactatggagaatccgaacggtatctcatcttccagcataatgaatacacccaaaagccaatcctcgatgatgaggggcatatgatattacgagatgaatattacctggatggtctgaactgtgatccttttacctttgcatctgaatgtcaggaactaaacagttattaccataaaaataaaaatttcaatgagatcaagtctcatcattacattatcagctttgacccaaaagacagagaggaatgtggactgactggtgaacgggcacaacagcttggactaacttttgcaaagaagaactttcccggtcatcaggctttagtttgtactcatacagacggtcataatggaagcggcaatatccatgtgcatattgtaatcaacagccttcggaaatatgacgtaccccaagaaccctatatggaatttgactgtgaatcaaaagccggatataaacaccacctaagcacagcctaccttgctcacttaaaacaagatgttatggacatgtgtcagaaagagggcctgcatcaagttgatctgctctctcctgctgaaagaaaaatcacggaaaaagaatactgggcacagcgtcgtggacaggaaaaacttgataagctcaaccaaaaaatgcttgaagatggtatcacaccaaaagagactcgctatcagacagagaaacactttctccgggatgctatcgacgatgctgcaagcaccgccagatcaccagaagagtttgccaaaatccttgataaaaaatatcatatcatcttcaagatcagcagaaaccggtacagctatcttcatccaggcagaaaaaaatatatcactgggcgaaatctcggaacacgatatgaagaggattttctattacaggcatttaaggaaaatgcaaaatcactctccgataggaaaatggaaattgaagaaccgcaagtcacaaccactacaaaagatttgcagacaacactttcgcctgatgcatccgatattcctgtaccgttcattttcataaaatcagatctccgacttgtgatagatttacagacctgtatcaaagcacagcagagtgaagcctatgctcaaaaagtaaaactctccaatttgaaacagatggctcagacggttgcctatattcaggaacatggatatgactctcttgaagatttccatacggcacttgaccaggcatctgatcagaccagtgccgccagaaaatctttaaaggatacagaacagcagcttaaagatgtgaatgaacagattcattttaccggacagtaccttgcatacaaaaacgtatatgccgactaccgtaagagccgcaataaggataaattctacgaagaacaccgggcagagctttctctttatgatacagctctccggacactgaaagaaaaatctgccggaaataaactgccttccatgaaagccctctatgctgaaaaagaccggcttattgaattgcgagatacacagcgggaagatttttctaaccgccgggattatgaacgggagcttcgtaccgtgtctgccaatattgatatgatccttgggaagaatcacgagcaggaacagcagattgaaaaagaacagaatttataagcataaaaaacgagtaaattctttgattatatgaatttacccgtttttttctattgtccttgaattttctaatacaaaattttatttcaataaccacttatgttgcctttttctaaaagaatatcctttcattatagataccttaatcttattctacctcattttcattgtcttctttttgattttccatatcctcatacaacatttttaacaattcatcataagacatcttacatccagggcaccttcccataagatcatgatttctaccacactgtggacattttatttcatcatttaatttactatattttctgtatccgagatcctcctgcataaaacgagctaccaagcttattcctatatcatataattctttacttttctccgacagttttggtcccgttattggggtatatgtaaaccgggcatataaaataaaatgcttacataatctaaaaatagtatctgacgcatataacctaagctttggtgaaatttccatatatttttgattttgttcatccaaccactttttatactcatcatttctttcaacaaattcttttgaataatcaaatcctcttctgacttgaagcaatctatctaacacagctatataaacttgttctttcttttcgctatatatcctctccttttcttcttctttatctcttttttcttttttcatatctataaatttattaatcatttgaaaggtgcaagtcacgaaagcagataaacctgccgaaataattgcaattactataggattattcatattttctccacctatttttttaattattttataccaagtatattataactcatgctatattttttcaatccattacctaaattttatatttctcacagcagcataactattatctgccaaccacaatgactccattttctgcacaatttctctttgtgactgttctcctatatttgaaaaactctgaatccatttaggcaatctcaaggcatccagcaaatcacctacagtatccactttgtgtctctttagtgcgttgtatattcgtgtattaaatttcagaaatgaaattggctcttctaaaatgttctctggcaaatctggatgtaatcttttagcattttctatacttcgttctttctgcacaactaaatttctattgtgattttcaagtccttccacaacatatattatatactgcggttttgccaagtattttactcccatcaaaatcattctgtgaactctatccgcttccagattcatcctttcagcaatcttcttttctgaaaggctttctttatatctaagtcgaatcaccgtttcatattcctctggaaaacatgacagagcaaactccaatcctgcttcctgatctggtgacaatttctgaatcctgttaccctttaattccttactcctctgcacaactgcatcccacagattttctggatactcatattttttcttactcatatatgttacctccaaaatcattttctactaatcatgcatggcaacatataaaaggtcataaaatttataaaaaattattttcttctttgcatttccatacttgaagtagagcgttttttcttattcacttgcattgaattattttttctatcaataaaagcatctgcaatttcaataagtacaagcaccatcactggggttctccctccaaaggctaaatctcctataagaataaactctttcctggtgaacgccaatataagtgataacaccaaaaaagttattttcataaagaaagccatgttctgtgcatctttactctttgatattgaaaatttatagtaaacaagacccataaacatagccgtcaataatatgaatagatttcgtagcataatatattttctcctccgtaaaattaaactaattgccgcctctatcatatattataagcactgatttctttttttcaacaaaaatggccctgccacataagtagcaagaccatttccattgaaaattacttcttcttcctttccatctcttcttccactgccctctgttgctgtggttgtcctttgctctgactggctatcttttgctgatgcttgcgaagtcgtttcaacactgatctccggggagcatttttatcttttttctttggagtattattcatcagtccatcaatcatgttgtaattggcttcttctgccatctccgcactgcgaagatattctccgttgtccatgaccttctgccagtttgccagctctggtttctttttctgctgctctgatgactgctgtatctgatttggttgcatttgtgattgcacctgctgttgtttctgccgttcctgttcattcactgcctgttgctgcataaagttctgaatgttccgtcttgcttcttcgtcaaagccattataacagtcattcataactactgcaccatcttcactgagaatcacataggcggctcttgtcccatactcttcatgttccatcaggaaccatttcttctcgttcatcaaaatataatcctgagcaagccatgtacctttctttccttcgatttcatatccggttgtatcaatggaaagtctggtatcagaggaacttttaattgtgagaaattctggaacaatgatgaatccatctttattaatatagtaagctgtggtttttccctcatctgtgataaccagaacatcgctgcatccgatggaatgacctttgaagttcttcggtcgctgtttctgcaggcgtatttataacgcataaaaatacccctttcactggatgtccagtaaaaggggtacatatcactcagatgatatcctgcggattttttattgattatttcgttgtttattttctactgtgtctgctgattcagcaatcgtttgatgacatcaatggtttccttgataccataattcgcactgttgatacaaaggtcataattttccggttttccccatttctctccagtgtaaaattcgtaatattttttgtgctgtttatccatcttcttcaggaaacggacagcctgcttcatatccatattacgaacatccataacatgttgtgtgcgtacctggaatggtgcgctgataaatatactgatatgtggaatatggttattcttaaggattgcatctgcacatcgtcccatgatcaggcagtcctctgttcttgccagttcacagatcagatcgctcatattaaagaagaccgcatcctgcttggaaagtccatgataacgattcaattctttcagtttcgtcttcaggctctcatgcgttttctttccatacttattgaaatccgtaaaattctctttatcctgaacattatctttttctgcttccaggcgtttcataacctgattaaagatttccacatcataatagttaattcgcagtttatcagcaagttcaaaaccaatatcatttcctgcacttccctgtgtacggctgatacagataaccaaatggtcattttctgagattttctctcttctgacagccagattcagtgctgctctctctgcatccagaatatccgtagaaccaaacatgtttggaagctgctcaattgctttgaggatctcatcatactccgtcatcaggcggcttttttctgccggatctttaatcgtacgagccatattactgatcagtgcaagttcacttcgaagaagatgtccgtccggttttgtatacatcagcatactcaacgtacggatcgtcgtatcacggtttccggtaaacgtacgtccaagagaagatcccagaacacgatatacttctgcatccagatcataaatacgattggcaagttctgtatatatttcacgattgatattttctgacataactctccccccttacataaagaacacaagcatatccagtatgaataccggaacaaggaataccagtgaccagcctatgtatccgaagaaggacggcatattgacaccattctcgtcagaaatagattttaccataaagttcggagcattaccgatatatgtgttggctcccataaataccgcaccacaggaaatcgcagacaaaagtttgaccggaactgtgccaagacttgttgtaactccattcaggaaaccaagggttcctgccgtggtaagaaataccagataagttggtgtattatccaggaaactggacagtgcaccggttgcccagaacatttcacgcggactggaaagtccgatatgaggtccaagtgctttcagaagcatcaaggccggttgcatggtaataaaaataccgataaacaataccgcaacctcctggatagccccccaggtaaaatggtttcttctacggatgctcttatccgttgtcttaaatgacagaaatgcagccagaaggatcataacaatctctatcagtgccgggaatgtcagtgtcacttcaccgaaaatgtggattcccataacttctcctgccgcattctggaacgcagaaagtcccggaagtaccccgctcaggataaccgctgccacgatcatcaccaggaagataatattatgcagtccttcaatatgaaattctgtaccaggtttactgatatccggtttacgtccctgtgcaatgtctttacgatatgccagcttatccacatgatagaatacaaacagcatgatcaccatgttgaagagcaggaccggtaacagatgcagactccagaaaaacggtactcctctcataaatcccataaggagcggcggatcaccgattggtgtcagacatccacccatattagataccataaagataaagaatatcataatatgactttttctttttctccacgaattcatcttgattaccggtcgtaccatcagcatactggcaccggtcgttccgatacagctggacaaaagagttccgaaagcgagcaggcaggcatttaccctcggagagcctgcaaaatcaccttccatggtaatattaccggaaacacagaaaagtccgaaaagaagaacaataaaagtaagataatcatttacaatacattcaagaactgtctctgttgctttgcctgtaccataaaccactgcaaacggaatcaccatcagcagaatccacataagtaccacatgtggctgatgtgcttcccaccattcagctttgatcagcggcatcacggcgatgcagagcagcagccccgcaaaaggaatgcacagccataccggcacctgagtggttgtttctccacttcctgctgcccagacacctgtcggacacatcagaagcatggacagaagcattccaaaaaatgttactgtttttttcaaagatgtcacccccacgtttagttttcaatcagtggaaattataacatacctgttgcaaattacaattgcactttcgttcaataaatcctgtatctctcctgttccttttgtgcatttttcctatatattgtatttttattagtgcattgttgtacttctgcaaagtatttctatatcaatttgtgcatttttgatgcaaattaactgtttgtataaaacaaagttttttgtatttttattcataaattaagccaacgggcaagttccccgctggcttaattttagtaatcgctgctggatcccgaaaaactctctccaccacttgaaaagcttcctgaatcattattatcgtttttgacttttgcagtctggcttaccgtctcatacaggaaaatatcatgtttttcgctcaattccagtccactatccgtcgtatattcactggcatccggctgctgcacacgtgttttcatcttacgtacctgataccaggtgagaactcccgttggaatgatcatgatcacaaatgccatgagaagatctttcacgaaccgtccgccaactgcttcatcactgagatccatcaaccggatattctctccttccgaaatgcggtcaagtcccgcctccagatcatgaatcaatgactgatatccaccgaatggatcatcatccttaagatatgtcttacatttatccagcatttcatcctggattctcgtagaaaactcattctgcgtgtctccgcggaatacgatcgtaatgtttctgacacccggctgatggaaaatacacataccttcatgagtatctccataaccaatttcattagcctgcataaattccgcagcatactgacgataatcttcgtcctctcccacatcctgtgagatccagagaacggcatcatatccatatgtatcatatatagtcgcaagttcatcattaagctctgtgatctcatcatcactcagaatcccgcaatcatcaaaaacccaggacatttctccattttcatcttcctgtgccgtctctgtctcagcacctgcatacaccacagccggtgaaagcacaccaaggctcatcacaagcagtgatccgcttaagataagattcattttcttcattcagatcacccccataaatcgcagtgctgtaacgattgctgtcatagcaattgtcagcgggatatgacatttgaaccagtattttactgccagatcttttcccaccggaaggtcaccgatcagacgtcccgtctgtccattcatggcaaacgaatatgtttttccattccattttgtattcagaaaccataccggaaaaaggccatattttacctcgcctttattcgttacagtaaccttctcctgcttcggcgtaacagttgcatatccttttacactcgcttcaaaacagtctttgacgctctgttccatacgttcatagacacgtccggtcagttcatccggttcctgatcatatttatctgccatatatccggacaggtaggacatattaaattctgtcagatcctgatattcatatggttcgattgcctccatcatggtatcatcgattgcctttgaaccatccactggtatttttcggaagtttatctttccggcacgggcgacatgataaaacctggttgctgtatagttatagtcatcgtcttcccatactctggtttttgtcgcctcatagctgaatcttcctgcagtatccatatcaaacaaccagaacggtacataaactgccctgatctcttcgagatgattttcatctttaaatactttcggaagaagcggttttccttcgtaatgtgccttaagtgcctgtttcgcttctttttttgatttcataaacggaatgatgtaatccggacgataactgtctttaaactgttccggcatgatcattggattgtcacaatacggacacaccgttgatcctgttgtcttttcggccaatatttcagctccacaggacggacagttccacactgccatatttgacttctcatctgactgccactgttccggttcaaaccctttccatttttcggtcttatcttcttctaccgtatcctgctgttctgccagtttatccagttcttccagcgaatacgtacttccgcaaaattcgcatttcatcttctgttctttactgtcaaacgtaagtccagccgaacagtttggacatttatagtttaatgtatccacccggtcacctcctcaggttatggtcttggtcgtccacattccgaacagaatttacccgtattagcagctccacagctgcaggtccacggtcctgccggacgcggctgtccgcactctgagcagaatttacctgtattaacagctccgcatgcacatgtccatccactgctctgctgagactgtggctgcatctgcggctgtgcctgctgccccattgcaaacaaattctgtgcattcactccaccggcattagatgccatattcatacctgcaaacgccattaccggaccggcattctgattagatgcagctgcctgcatagcacttgcctgcgctcctaccatatgtgctgctgccattgtcggattacggaacgcagcatttctctgcagttctttgatcatcgcttcatcttcttcggatgctttcacactggacacaccaagtgaaacaatgcagatacctcttaagttattccatttttcagtaagtacctgattcagtgcatcagaaagttcctgtgtatgtcccggaagtgcgctgtaacggataccctgttccgaaattttcgcaaaagccggctgcaatgcggtcataagttcactcttcaactgaccgtcaatctcttcccgttcataatcctgttctacattaccacatacatttgtataaaaaagaatcggattggcaattcgatagctgtattccccaaaacatttaatagaaatatcaatatccagtccgatattgttgtccactacacggaaaggaaccggattcggtgttccatatttatttcccacgagttcttttgtgtttacaaaatatactctctgatcttttggtgcttctccaccaaaagtaaaacgcttgccgatctgttgaaaaacacttttgattccctcgcccagatcaccacagaaaagagatggttctgtagacatatcgtaagtgtattctcctggttctgcacagacatctacaacttttccctgttctacgatcagcatacactgtccgtcgttcactgcgattacagatccgttggatatgatattttctgatccatgtttgtttgatgatctcccagaaacttttttatgtgcttttgtaaccagcacatcggctggcatagcctcacagtaaaaatactctttccactgatctgccagtaccccgccggctgctccaactgctgctttgatcaatcccatacgtaattcctccttttctgagaactgctctgtatcagagcttattattatgaaagtttatgtataaacagaccgcttcgaagtttcggttcaaaccaggtagatttcggcggcatgagtttattttcatctgcaatctgcatcagatcttccattgccgtcggaaacatggcaaatgcaactccaccagtcttatctgcaatctcggcaagttcactcaacttatggctgccacctacaaaacggattctctgatccgtacgcggatcaccaatgccaagaatcggtgtaagaactttttcctgaaggatagacacatccagctgacctactacatctttcttctcataaacatcttcccatgcttttaaatgataccagtttccgcccacatacatgcccatgcagtgtttttctactggtttacacgggaatcccggcatgatcataagttcaaaattaaatttcagactggcaataaaagcatgttcatccattccattcaggtcatgcaccactctattatatgcaaggattttgagctgatcatatggaaatactacagaaaggaaataattaaattcctctgttccatcataatccggatgctcttctcttcgtttaagtcccactttcactgccgatgctgctctgtgatgtccatccgcaatatatatagacgggatattttcaaactgctcacgtatcgtctcaatctcctcattcccgtcgatcacccacacgcgatgcccaatttcatcatctgcaacaaaatcatatactgctgcgtgagatattttccattgttccatcaaatcaagcaactgctgtggatagcggcacgcaagataaatcggtccagtattcgcatcacacacatctacatgacggatacggtcctgctccttatcttctctggtaagttcatgtttttttacgatgcccttcatataatcatcgattgaacagcatccaaccagacctgtctgtgtctttcccttacgggtaagttcataaatataatagcacggtgtttcatcctgtttcatcacaccatttttttccatattcaacagattctgtcttgcgcgttcatatactttcgagtcatacagatctgtatcatccggcagatccatctcagcacgatctacgtgcaggaaagaatcaggatttttatctccaatcgctttcgcctctgcacgatctaccacatcatatggaagtgcagctacatctgctgccttctccgaaacaggacgcaatgcccgaaacgcctgaaaaatagccatattcattgtctccttttctgtctcatcacttatgtataaagatagtttcatcttatcacagcaattgtttattttcaacaaatgacactttttttttggtgtgctaactttttttgtaaaaacctaaaagtttttgtattttctcttgcaaatttacatatttatgatatgatagttttagaaagaaaagaaaaattatgagttcaaaataaattttttaaggagggttttcaaatgacagaaggtttaaaatggactgtcaatcacgttgccagatctgacgacaaacatctcgagttaatgtccgaagagaacgtaaaaaaggccaatgaatttcacaaaagttttcctcaatatacagtaactcctcttcaggatcttgctgaactggcatcctatcttggtgttaagagcatccattgcaaggatgagtcctatcgtttcggactgaacgccttcaaagttcttggtggttcctacgcaatgggacgttacatagcaaaagaagttgggaaagatatcagcgaacttccatatgcggttctttcttctgaagaattaagaaaagaattcggacaggctaccttcttcacagcaacagatggaaaccacggacgcggagttgcatgggctgccaaacgtctcggacagaaagcagttgtccgtatgccaaaaggaacaacgaaaacacgttttgacaacattgctaaagaaggtgcgactgttaccatcgaagaagttaattacgatgactgcgtaagaatggctgcagctgaagccgccaagacagagcatggcatcatcgttcaggatactgcctgggacggatatgaagaaatcccgtcatggatcatgcagggatatggaactatggttatggaagctgaccagcagctcaaggaagccggaatcgaccgcccgacacatgtatttgtccaggcaggtgttggttctcttgcaggcgctgtcgttggttacttcgcacataaatataaagaaaatccaccagtaatggttgtctgcgaagcaagtgctgctgattgcctgtaccgttctgctatgaaggaatccggtgatcttgtaaacgtaggcggtgaccttcagacgattatggccggtctcgcatgcggcgaagcaaacaccattggatgggatatcttaaggaatcacgtttctgtgtttgcatcctgcccggactggatgagtgccaaagcaacacgaatctatgcgaatccgctcggtaatgatccgcatatcgtttctggcgaatctggttctgttccgcttggtctgtgcttcactgcccttcacgatgaagatgcaaaagatctcaaagaagctctgaaactggatgaaaactccaacgttctcgtaatctccacagaaggtgacaccgatccggttcgttaccgcgaaatcgtatgggatggactgtacggaacaaacgaatctttaagcaagtaatcaaaaactcaaaaattatttcatatacatgggaggaactttaaaatggattacggcaaaatcaaagaagctgctcagaattatcaggaagatatggtcaaattcttaagagcaatcgttaaaaatcctggagaaagctgcgatgaaagaaaacatatcgaaacaattgaagctgaaatgaaaaagctgaacttcgatgaagtaactattgatccacagggtaacgtcatcggttacatgggatccggtgataagattctcgcttttgatgcccatatcgatacggttggtatcggtaacatcgaaaactggaacttcgatccatacgaaggttacgaaacagaagaagaaatcggtggacgtggtgtctctgaccagtgcggtggtctcgtatctgctgtatacggtgccagaatcatgaaagacatggatctgattccggaaggatataagatcatggtagtcggaacggttcaggaagaagactgtgacggtctctgctggcagtacatcatcaacgaagacaagatccgtccggaatttgtagtttccacagagccaactgacggtggtatctacagaggtcagcgtggacgtatggaaatccgcgtagatgtaaagggtgtttcctgccatggttctgctccggaacgtggtgacaacgccatctacaaaatggctgatatccttcaggacgtacgttcccttaatgaaaacgatgacgctgacgaaacagagatcaaaggtcttgttaaaatgctcaatccaaaattcaaccctgactgggaagaggctcgtttccttggacgcggtactgtaactgtatctcagattttctacacctctcctagccgttgtgcagtagctgactcctgtgcggtatctcttgaccgtcgtatgacattcggagaaacatgggaaagctgcctggatgagatccgtgcacttccaagcgttcagaaatacggtgatgacgttgttgtatccatgtataactatgatcgtccttcctacacaggctgcaaatacgaaatcgagtgctacttcccgacatgggctattccgaaagatcacaaagtaacaaaagctcttgaagacgcatacaaaaacctgtacggtgaaacccgtcttggaaatgctgaaacagaagaaatgcgaaaagcacgcccacttacagataaatggacattctccacaaacggcgtatccattatgggacgtaatggaatcccttgcatcggattcggtcctggagcagaggcacaggcacatgcaccaaacgaaaagacctggaagatcgacctcgtaagatgcgcagcggtttatgcagctctgcctggttcttactgtaagtaagaaagaacaacaaagaacggggttctttgaacttataaaggacgaagtcctttgaaccttgcaaagggagcgaagccccgctccctctgcacacccttggggctaaaagcacagtagttctacactgtcagatcagaaggatattaacttaactaattataagctctttgtgttgcaagtataaactaatagataattagctgctacagacagagtgaacaatatctataatgcttcaggccgtaagatgaacaaatagtcaataaacgaataaccacacacgaaatgtgctaattaaggcgttttttcttctcagtgtggggaataaatatttcataaggtgatgatctgagacggccggtacttagtgaccgtattctggtcacttatgtaccgctgccagtcgaagtcagcgagagcgtgtcaccgttgaaatatttgattccatcacacgttaaagaagaataatcttagtcacacatttcccacaaaaaggagaaaaacatgaaaactttacaggattacatcgacaaactcaacaaacttaacttcaaagaaatgtataacaacgatttcttctggacatgggacaaaaccgacgaagaactcgaagcagtatttaccgtagcagatgcacttcgtttcatgagagaaaacaacatttccacaaaagtatttgaaagtggtcttggaatctccatcttccgtgacaactctacacgtacccgtttctctttcgcttctgcctgcaaccttcttggtctggaagtacaggatctcgatgagaaaaaatcgcagattgcgcatggtgaaactgttcgcgaaacagcaaacatggtatccttcatggctgacgtaatcggtatccgtgatgatatgtatatcggcaaaggacatgcataccagaaagaattcatggatgcagttactgagggaaacaaagatggtatcctcgaacagagacctactcttgtaaacctgcagtgcgacgttgaccacccaacacagtgtatggctgatatgcttcatattatccatgaatttggtggtgtagagaacctcaaaggcaaaaaaatcgctatgtcatgggcttactctccatcttacggcaaaccgctctctgttcctcagggtgttatcggtctgatgacacgtttcggtatggacgttgttcttgctcatccagaaggatacgatgtaatgccggaagttgaagaaattgctagaaagaacgcagaagcaacaggcggatccttcacaaaaacaaacagcatggaagaagccttcaaagatgctgatattgtatatccaaagagctgggctcctttcgctgctatggaaaaacgtaccaatctctatgcagaaggcgatttcgaaggaatcgacaaactggaaaaagaacttcttgctcagaatgccgaacacaaagactgggcttgcacagaagaactcatgaaaacaacaaaagacggaaaagctctctatctgcactgtctgccagctgatatcacaggtgtaagctgcgaaacaggcgaagtcgatgcatccgtatttgaccgttacagaatcccgctttataaagaagcaagcttcaaaccatatatcattgcagctatgatcatgctttccaaatttgaaaatccgcaggataccctgaagaaactggaagtaaaagctgcaccaagaatcatgaaataattttttatcgggtaggtttttacaatgtataaaagaaaaagaattgtgattgctctgggcggaaacgcccttggcaatacactcccggaacagatgcaggccgtcaaaaccacagcaaaagccctgtgtgatctgatcgaagaagggcatcaggttgttgttgttcatggaaatggcccacaggtaggtatgatcaacaatgccatggcagctctttccagagaagacgcaaaccagccaaacacgcctctctccgtctgtgttgccatgagccaggcatacatcggatacgacctgcagaatgcgcttcgtgaagagcttcgcaaacgcggatttatgcgcacaccggtcgtaactgttgttacacaggtacgtgtcgatgaaaatgatccggccttccagaatccaagcaaaccaattggacatttcatgaccagagaacaggctgaacatgcagaaaaagcatatggttatgttatgaaagaagatgccggtcgcggataccgccgtgtcgttgcttccccgaaaccagttgaaatcgtagaacaggatgcgatcaacagtcttgtagatgcaaacaaaattgttatctgctgcggcggtggaggaattccggttactcttcagggtgatcacctcaaaggtgcatctgctgttatcgacaaagacttcgcaagctgcctgctcgccaaagagctggatgccgacatgctgatcattctgacagcagtcgaaaaagttgctgtaaacttcggtaaagaaaatgagaagtggcttgatgagatgacagttgaagaagcccagaaatatgtagacgaaggtcagtttgcaccaggttccatgcttcccaaagtacaggcggccatggattttgcctcttccaaagaaggacgctcagccatgattacgcttctcgaaaaagccaaagacggtattcagggcaggaccgggactaaaatccatatttaaatatcaatgccatgatataaaaaagtagtataatctggtcaaaaaaacagattatactactttttctcttttagctctggcaggatcgtggcaatcattgtaatattcaatccaacaaaaaaccacaaataaaagccacaaaaaatcatatttttttcttgtgtttcaacgaaaaaaaaggtataattatattaatataaaaatgtataaaatcatattctatataatgattgatggaggtattatggctgagaattataatggcatggcagttggtatctttgaacttgacagtcttgctgcctgcttcgtagcacttgacgctgcttccaaagcagccaatgtaaaaattcagaatgttgagcgtaatcgtcttggtgccggtgcatgcgtaaaaatgcgtggatctgtatccgatgtaactgctgcaatggatgcagcccttaaagtagctgagccgctgacaaagattttttctcatacgatcattgcttctcctgctcatgacacagaaccggctatgtatatgacagcaggtaaataataaccctgaatatttgattaaagtgaggatcatactatgaaatacggagcattcggattagttgaagtattaggaagctgtaatgcagtcatggtcattgaccagatgctcaagacagcagacgtatcttttcgtacctggaacggcaaatgcggtggacatgaagttgtttttatgagcggtgatgtatctgctgttactgctgctgtagagtctgtaaaacagaatccaccatgcgacattattcttgcggcagtgatctccaatccttctgaagaaactgtacgtcttgtagaagaagatgctgctactcatcattttgcataatcattgtttattcagagacctgtctgtatcaggtctcttttttatttcattgacaaaaaagcaacaaaaaaccacatcgaaaatatcactaatccgatgtggttttctgatttaaaatttcataggaatttccttagcgattaaacactgcaataccaagaccctcttcacgtactacagtccacatagcctcattgatctcctctaatttatatctatgtgtaatcagtttatacagaggaagtttcatttctgctgcttttgccaggaaattcatgcagttttcataatctcttgctgcataaaatcttccaccagccggcatgctgtcttcaaaatatctcgctgtaggagttcttctccatccacaaagaaatcccatttcgcaaatgcttccgctgtttttcataaatcttcttgctacatttcttcccataggcgaatctgtacagataaatactgcatctgccatatcacctgctgctgcacggatcttgtccttcacacctgcaacaccattttttccatgggaaccaataaattcccatgctccaaattccattgcacgagatttttcactttctttgtcaattacaataattttattgattccaagtgtttttaatgcagccacggtcagaagaccttccattccacatccaagtacaactgctgttttatcagcatccagtttacacattttggacatgcgttctacttctgtataaatagaaatacttctcgtgatcagcagtctggattccagatccagaccgtttacctgatatacctgctgtccggccggcaatacgatgtaatttgcaaaccatccattcggtgcaactgtatttgcctttctgccgccatatgtagaaacaccaccaaatccggctttctttgccgcaatgactttgtctcctactttcaggacatttcctttggcatcctgaagattctcacttccaacctttacgatgataccggttccttcctgtccctgtgcagaagaacctgctgctcttctttctttcagaaattccgtaacatcagaaggagaaatcatgcatccctccacacatacaagaatttcttttggtccgacttccggaagaacataatttttgatcatataatcttcctgagaatcgagaaccgctgtttttccaacttctcttccagtcagtgccggtgtttcctctaatacaaaggtcgttttcggctgcaccggtctggaaggagcatctatctcagacagaacctgctttacaatttcgtcaatctttatatccatcttctatctcctttgccatagactgctgttctttccattgctggaacaccatgaagcagcttatctatttttatcttcacaacaaccttacgataagatgtctgttctttctcgtggcagcatggtttatgtccgtcatctggataaaccagataaaacattcccggtttcatctgaattctgtttccacacccggaaagccactcaatatcagcttccggatcataaggagtctttaccgccagatctgccctgtctgcatattcccacatttcagatccgttcagaaggatctgtacatccaggtaattacgatgtacctcaaaatctgcttcttcgaagcttcttgtattcccttcctgtacaaaagcaaatcctttaccaaccggatatttgcccggaggaagctgttctttctgaacacgttccgcaaaacgtacggcatcccataattccggaacacttctctggtaacaacggaagcgttccaatcgatccattatcattatcgccagctcctgtctctttataaaagttccagatctctcattttattgtaaacatttgccttcgctgttgcatcaagtgaaagtgcaggaagtctttcctgaccatcatgatgcagcactctgtagtacatagcctgtttgcaagccaggaacaaaggtgtgctatatgcatagatatccattgcctcaaccattttgttgaaccattttgcagcttcattaaaatcgccgcgttttgcactctgatacgtattaaccgtatattccggtgcaaagtttgcagttgcattgatgaatccatccacaccacataccaatagacccattgcctggttttcatatgctgaaaatacagaaaagtccggattgatttcttttactttctgcatgctgagtacatgattgaaatctgcaatcgtatctttgattccgactacattcgggtttgcttttacaattctggctacaacatctgcattgaagcagtatccggtaagatccgggaagttgtagataatgatcggcagcgaagtatgagaagcaacatatccaaagtatgcttcaaccatgtctgtactgtatacactgaaataagggttgatcagaagtactccgtctgcaccggcctgctcaacaaatttcaacagatccatcgtgttttccagacaggtatctccgacaccaacgattacatttacgcgtccatttacatatttgatcatctcattgatgaagtttttcttttcttcaacggtcatgatactgaactcaccggatgttcccagataagcaagaccatcaacaccttttgagatcagaaaatctgcctggcgtttgctggcttcaatatcaaccttgtgatgttcgtcaaaaatagtgatcactggtggattcactccgcacaatcttttcattttaattcctccttataatatcccagatctcttgacagatcacgggctgtttttaacatttcagtttttaaaagttcctttttttctaccattcgctgtttcagaccagatacactgatcgcagctttcatatggccggtattgtcatagattggcacggccatacaccacagtccctgttcaatctcctgattatctactgcatatccctggttgcggaactgtgcgatctccttcttaagttccagtttgtctgtaaccgtatgctctgtaaatgctttcagttcaatgcggtcaataatctgagagctttctttttccggaagaaacgcaagaaatgcttttccaagtcctgtacagtatacaggttttctggatccaatactcgcatttgtggtaatggtacgttcacagttttctttcgcaatataaacaatctcatcaccggaaagaactccaaggaaacaggtttcttccactgtctgcataagtttcttgagatatggcgtaccgatcttgttcagatcaattctggatgcggcaactgcaccaaggctcatcagtctgcctccaagataatatcttttctgttcatctgctgacagataaccattctcttccatcgtctgcaaaagtgcaagcgtactgcttggagcaaaccccagaaggctgcttacttctttattcgtcaggccctccgggctttgttccaataattcaaaaatcctaaaaactctttccgctgatttaactgccatagatctacctgcttttctttttttcatacgtaactatttcttccgctctgaatagttactcctactgtttattatactacaaagaaaatcttactgtaaactgtttacacaggctatttgctgattaatctgtttcacagcagtttcttttataaaacaggagcccacgacgtatgtctgaggactcctgcttgaattacatctgtttattagaacaggcaggaaatacatcctactacaatgatcagaatgattccgactacagacgcaatagcctgtcccaatgtataagtcttaacgccacctgataaattcaggccggccatattggaaacgatccagaaaccagagtcgtttacagttgcaccgaacagtgcaccgtcaaggcaggcaagagccaggaataccgggtgacatgcaattgttgcagtaacactctgcatgatcgcaaatgttgtcagtgatgctactgtaccggaaccggtgatctgacggaatgccataccgaggaaccacgcaatgaacagaatcagtgctgtatttcctgaaataccggaaacaagatttttgatcgcatcacttacacctgctgctgtaataacagctgagaaggagccgccggcaccagtgatcaggaataccatacctgctgaatgcagagcattggcagctgatgcttctgctttcttgaggcccattgtcttcatcgcaatgatcattgccacaagagtaccacagagcatggatgtcgtcttctgtcccaggaatgtgatccatgccggagtgcttccgaccgctccaacgattgtattcagaaggatcaggacgatcggaatgataattggaagtaaagatactccaaagctcggaagtttttccggtaattcaagttcatctacgttcagtccgttaccgttttcatctgtttctgcattccagagaccttttttcatgagcatgccatgaatagtaacagaaatgatcatcatcgggataccgaaaagaagaccagctgcaatcatgacaccaaggtcaaagccgaagtactccggtgcaaccagagggttgggagtaggaggcaccagagtatgtgcaataccagcaccaatagaaattgccccgacaatgtatccaattcctttgttgagctttttcataagagctacaccaattggaatgaggataacgaatgtaacatcgaaaaataccgggattgacaggataaatccagcaaatcctacagcatacatagcatatttttcagggaacagagacaccagcttatctgcaataacagtagctccgccggtatcacttacaaactgtccaaggatgataccaagaccgatcgggaaaccaatgcttcccatcatgtttccaaaaccattgttgataactgtgatcagaccatttgttactgttccgtccgctgctgtaatatcattgagcggcaccttggtcagtactccgagaagcagagaaccaagaataagtgcgattgccggattcatttttacttttgtacagaaaaaaactacaagagcgatagaaatgatcaggcagatgattaaatatgttgctgacataattttccccctgcattagctttatgctaacttctataagtttttttattacaatcttaaattataatcttgtaccttttttaacctcaacaagtgtcttatctttattcagttcaacaccaaatccaggtttgtcgctgactttcagtttaccgttgactggcattggctcgtctttcagcaatggataatactgcggaacaaccttatcagcttcaggagccatcatcaggcactctgtgatcggtgagtttgtcttggttgtaacgtaatgatagctgtatgtaccgcttccatgaggaatgacatattttccatgagcttcagccatattaccaattttgataagttcggtcataccaccgcaccagccaacatccggctgaataacatcaaggtcacagtcctcgatcagcatacggaatccgaatttgcttgcctcatgctcaccaccggttaccatgatctggttgccggctgctttcttcagatctctgtatgaccagtaatcatccgggttgaaacattcttcgatccagttaaatttcagatcagcagatgcctgcatgagacgttttgcatactgaagatccagtgccatccagcaatcccacatcagaaggaattcatcaccgcatttttctctcatatcagctgcaagttcaatgctctttttgagtccttccattccatcagccggtccatatacaagcggaatctttccacctacaaatcccattttcttagcaagatccggtctcgggccagtagcataaaatgtaagttcttcacgaactttaccacccagcattgcatatacaggctcttcacgaagtttaccaagaagatcccacagtgcaaggtcgattgcagagattgcgttcattacaacaccttttcttccatagtaaagagatgcacgatacatctgatcccaaatcttttcaatttcatttgcatctttaccaaccacgaaacgatccagatgattcataaccagccatgctgccggatatccacctgttgtgataccaaatcctgttactccgttgtctgcttctacttcgacaaccagagtctttaatgcgttgataccaaagcttgttcttgtagctttgtactccggatagatactcatcggagttgcaatctgttttacgatccagtgctctgcggactggtcatggtagtcagctccaccgccttcaactacatacgctctgattgctgcaatttttctgcccattaatgccattgaaaaatacctgcctttcatatatatttgttttttattgattattagttttatccggtccacgtttcaattcatatatgtgaatcggattcttgttttatgaattcatcatacactcttttccagttatcgtcaatatcctttattattttctatattttattcaaaaataattttctttttttgtacaaaataaacagtacctgtctattgatttttgcatttgcatcaggtattctaaagaaagatttgtattaggaaggggtattttcatgtttatcttaatttttaatcagctggtaaaaatgctgattatccttatcgttggcatcgtctgcgtaagaatcgggcttgtttccaaagaaggaagcaaaaccatttccaatcttctgctgatgcttgttaacccgattctgatcattatggtctatcagaccgactatgatcccattctcgtaaagggacttctgttttcttttgtcgccgcatttatctctcacatccttgcaatcctcgtatccaaactcctgtttcgtgataaagaggatcccaataacatgatcaatcagtttgccgctgtatattccaactgtggctttattggtattcctctgatcaacagtgttctcggaagtgagggtgttttctatctgaccgcatacatgactgtatttaacattcttacatggacgcatggactttctcttatgaaaggtcactttgatccaaagctgctcaaagaggggctgactgccccaatggtcataggcacttttattgctatgatcttattctttacacagatacatattccagacacgattgcagcatccatgcagtacattgccgatatgaatactcctcttgccatgatggttgccggtttttctgttgcaaattcggacataaaaaagatctgcacaaatgtacagatctatcgtattgctcttacaaaactcataattgttcctcttgtggttcttctctttctgtggatcgcaccatttaatgctgacatcgcatatccgacgctgatcgcatctgcctgtccgacaggaactacgatcaccatgatgtctatccgttttgataaaaatgcagcctatgcctccgagatattttcattcacaacggttctgtctattatcacaattccgctgatcatttttatcgcaggtttcctgctgtaaaaacatccggttcatctgcatcctgaagttccctggcatttctgatctgaagatatgccacatcttcaggatgtttttttataatttttttgccgcctttatctcccgatatctccatcagttcttcgtaatatttctgcccaaaaatgcagggatttccagtctttccattccatctgatacaggccattccctttttttcattttcaaacagttctgtaagcgcaacaactgtatccgcttctaaccacggttgatccgacactgtaaaaaggcatgcatctgtatctcttacactcatcagtccaatctgcatggaaagtgaaatcccatcttccggtcgtggatttataaaaacagggattttcatttctcctgccttttttacaatttcttcatactgggtaacaacaatgatctcgctttccggaattttttctgatgctttcttcagtttttccagcgttagcagatacatgggctttccttcaatttcatataataatttgttactcccaaaacggcggctgtttccagccgccagcataacaaatgcaattttcatctgtaatattctctcccctgaaggcttccccaggcagcatggactccctgctcctgcagttcttttccaattctttccgctgattcatactttcccataaggtccgtcttattcaaaaatattttatatggacgtcgtccgactgctttttttaaagccttgtctgacaccgcaatacgtatgacatccgcttctgtaaccggatccgtttgctccttattcagaaaagcagctacccgctccggtctgtgacagctttctctgatcatctgccctactgcatccattccgatcactccaactaccagatctgtaaaatccggaataacaggctcccattcacctggcacttttagaggcagccttttagccccgtctgcttcgatcaatatacagtctgcctgccctttcagccgtacaagagcttcttctgtcagacttccgatcttacttttgttctgatccaggctggcagcaaccgtatatccatacttttctatattctgctggatctgctgagcatttccctcttccgcaaatggccgttcaggctcataagccatatgtgtcgttgtcgtaacaatcactttttttcctgtagaaaccatttcttcacataagcgaaaaatcagacttgttttacctccaccgccaaccacggcaatcgactgctttctatccggcacaatcgtaagtgcgttccacaaaaaaaacgtctgcatcacggcagtacaccttccgaaagaaggatttccacaacgcttcctgcaatacagcgtgctttatctgaaatcgtatcacagttctttttctgttcctgccgtggatcaatatctgctattttcatccctttggggacttcataaccatctcggataatccctctcagtacaccggtcagagatgcatagaccggcacatcatccaccctcgccagaatctggtctttctccacgatatccccaatctgcgaaagattgtgcatgattcctgctgctggcgaatgaatcacacgctctttgccatatcctgcgatcacccccggaattcccgtgtttggtgtcgcactccctttccggatcacacgtccaagattatgacctctctgtgtctcaatcacaaaatcaacatcttttccagcttcaaatcccggtcccagtgcaacagtaagcgatgccatatccttgttcgttccaagattcttttttgccagaattgcatcgatcagtgcagctggtttcaatttttttgcggtttctcctgtttcatccaccaaaatcggaatttctttcgcttcccagattttttctgcatcagcgatatcactgatcagacgtcccgtaactccctctaccgctgatgtgccatcaaatacagcctctccgaaggaaacctttctgcggattgcacttggtttgtgacattccagcaccagtacccgatatccacagcaataaagtctgtgtatcactccactggcaagatcacctcctccgcgaacaatcagtattgatttttgttccatttattctattccatccttttctgtattttcatgcataactttttccactgcattgacaatattctgatatccggtacaacggcagagatttccagacatttttttcttaatttcctctctggtcagttcttttccctgttccagaaggactgtcgcagacataacaaaacccggtgtacagaatccacactgaattgcaccctcttcaataaaggcttcctgaattcttgtcagttctccgtttttttcaagaccttccagtgtacggatattttttccttctgcccagacagccagataaatacaggaatcaatcgtttcgccgtcaatgatcacggtacaggctccacattcccctacttcacagccttttttgacggaagtaaggccgagatgattacggagcatatccagcagagattctctcggatctacatactctgcaacctcttctccgtttaccacgcattgaacaagtactttttcttttttcatgcgttttcacctccctgctgctttgcattttctgcaagttccacagtacggctcagtgctctccgtgcaatttctccaccaatctgcagacgaaaatctctggaagctctccatgaatctcgcggatgtatctcgcttctgacactctcctcaagattctgataaagagacgcatccagttttctgcctttcaataaagcttctgtctctgtacagcgatatggcactggtgctgctacgccaaatgtaatacgaacatcctccagaatattttctgcagtatcaactttacttaccacactgcagctcagcgtcgcaatatccatggcatttcgcatggaatatttgatatagtgtccatgatatccttcatattcattctttggaataatcacatgtgtaagtacttccccctgtttgagagctacacgtccaggaccaagataaaattctctgacagggacacttcttccgccttctgcatttgcaatatgcagcagcgcgttataggaaaagaccgtcgggacactgtcagcactgactgctccattacagatatttcctccaatcgttccgatattgcggatctgtggaccgccaacctggtcaacagcttctcccagaaccggaatatatttctgaatgatcggatctgctgtaatatgtgaaaataccgttcctgcaccgatataaatatcgccgttttcttttcgctcaattcctttcagttcttcaatatcccgaatagataccagtgaggttcctgccatcctgccctcacggatcttgatcagaacatcacttcctcctgatatgatcctggtgtccggatgttcattcagaagtgtcactgcctctgaaacggttcctgcattatagtatttctctatatcatacattctctgcgccccctctcagatcaatcctgcttttttgaatccgtcgatcagtctctgcggtgtcagcggattttcataaaatgccaccccggtcgcatgaagtactgcatttcggattgccggtgcacatggaattgccggcggttctcctaatgctttgtttccatatggtcccatcggatcacacaattccacgaaatccgctttgatatccggcgtatccagcatcgtcatcagcttataatccagcagattgccattcaacggacgtccggtcttttcgtccagaatcagctgttcactgattccataccccattcccatagacataccaccatggacctgcatctcggcaagctgtggattcagcagctttccactgtcatgtacattgataatatgaagaatcttaattttaccaagttttatatccacttcaacttctgcaaaacagcatcctgttgcaatcgtattttttttcacctgttcagaaacttctgctgtcaatacggatgaatttgtaaggctgtaatagctctcttctgccagagccgcaagagagattgcctgctcatcacctgcccagatccagttatctttaagtgtcagttctctggtgtcgatttccggaaggagcgtcttcgcataggcaagtatcttatctctcagaatctctgcacaatgccgcactgctgttccggtcacaaaagactgtctggatgcatacgcccccgtatcaaacggtgacacatctgtatcctgcaccgttttaatatgtacatgttccatatctgtgtgaagtgtctccgcaaccatctgtgaaaatacagtatctgctccctgtccgatttccgttgccccaagcatgagctgaacacttccatcctggttcaaagaaagtctggctcctgcaatctccagagaaatcggccatacacctgtcttgtaagaaaacaacgccatgccaacacctttccgtacatctccggcctgttctgcatattcttttcgcttttcatcccaatgaatatattctgcacccttctccagacattcaaaaattccgtttgtattagctgcgattggtttcagataagcatcttcataatatccctgaatcagatttttgcgccgaaattccaacggatccatatgaatctcatttgccacatcatccataaaactttcaatagcaaaacatacctgcgggattccataccctcgcatggctccaccaaccggcgtattggtatagattgtataagcttctccccggatattcggacaggcatactgcagccgccaggaagtcagtccgtttgccgcaatcgcatgaccatgagaggcataagcaccctgatttgaataagaatgcatatcttttgccagaagtctgccgtccttgcctaccccggctgccagatcaaattcaatagaatggcgggttcttgtattacagaatgtctcttccctgctgatatccagtttgaccggtctgcctccgacctgcgttgtcaaaaaagcattcaatggctcataaagcacatcctgtttattgccgaatccccctccaatatatggtttaataacccgtacattgccccacggaattcccagtgcctgaccaatgacacgacggacgatgtgtggaatctgtgtcgatgtcaccactacgatcctgcctttttccatataggcataagaaatcggattttcaatatgacagtgctgcacgattggtgttttatatgtgccctttacaattgtttcagcctgctccatccccttatctacatctccgataaaataattagaacgggcaaggacattatcttttttatcaaaatgaatcggcggattactgccatacatagatttgcgtggatggatttccaccggatattcctcatattctactttgatcagcttcagtgctctggctgcaatgatctcatcttctgcaacaacagccgcaatatcatctccataataccgcacacgaccagtcagaagattacggtctgccacatcctgatgtgccagttccacagaccacggatgccctggtgtcggataacagtggtctggcacatcataaaaagtcactacttttacaaccccttccagtgccactgcctcacttgtatcgatagatttcacaattccatttccaatcgttgcatgaagaacttttgccacgagacatctgggcggtaccagatcatctgtgaatttggctcttccggtcactttttcataggcatcaactcggggaacgctttttcctatcatgatctcaccttctttatagaattttgtcaactggaatcctgtcactttgtctttgtaaatattccacgcagatcataaattgcatgacgcgggcatttcactgaacacatgccacagcttaaacacatattttcccggatcactgcatgattgtccataatccggacagcacctgccgtacaggtcttttcacagattccacagccaatacagcttaccgcacactgtttttttgcctcagctcctttgcttttgttagaacatttgactacaatataattggcacattcatggatatggataatttcctgcggacagactttcatacattttccacaggcaaggcatttatcttcatcgacttccgccacaccatattcattcagggaaattgcgccaaatttacatacgctgacgcaagctccacagccaatgcaaccatctgtacatccttcttctccctgtaccgccctgcatccaccattacatgctacaagggcggatctgtatggaaatcttttttttgctgccatatcaacccttcctttcgtatggtgtatctgtaagcggcagattatatctgcgaattccatcataacggaaatatgcatctgcaattgccggtgcagtaggaatggatgtgatctctccaatgccgatggcaccgcatgcaaccttcagtcctggtttatctacaacgattgcttttattttgggaacttcatgtgaacggaataatcccagtgaaccatatttctgaattggtttacaattctcatcaatcggatactgttctctgagcgcgtatcccatagacatgacaacaccaccctcgatctgtccctcgcaggacagcggattcactgcctttcctacatcgtgagcggcaactatgcattccagcttcccgctcttcttatccagaacgcacatctgtgttgcatatccataggccacatgtgataccggatttggtacattggcgccaagcggatctgtttttgcgaggtattctccgtagtataccttccccttcatatctttcagctgttttccggcagtgcggtcttccatcagtttttcgcatgctctgcggcaggcttctccggtgaccagtgtctgcctggatcccgatgttgttcctgaatcaggagagatccatgtattacttctttcatacacaatatcctcatgtttcagatctgtatttgtaacgaccatctgcaccagaactgttccaagtccctgtccaatacacgatgctcctgaataaatatgcagtttttcatcatcctctacgatcagtttaacgcgtccggtatccggaattccaactcctacaccggcatttttcatcgcacatccgattccaaccggttttcccgctgtcattgctgcatcataatcttcttttactgcttccagggtttctaccagtccggtcgatgcatctacgatctgaccgttcggaagcacttctcccggacggattgcattacggtaacggatctcccacggtgtgattccaaccttgtcagccatcatattcagcagcgtctctgttgcaaaacaggtctgtgtaacgccaaatcccctaaacgctccggccggtggattattggtataatatgcagtcccttcgatatcaaaattttcataatgatatggtcctgccgcatgcgtacaggcacgttccagtaccggaccaccaagtgatgcaaaagcccccgtatctgaagacacaattgcttttactcccataatatttccttcttcatcgcatcccatcgtcatatccatatagaacggatgtcgtttcggatgtatcagaagggattctgctctggtaagtttgactttaactggcttctttgtcacataggtcagcaatgcagccagatgctgtacggtcatatcttcttttccaccgaatccacctccaaccagtgcattctgtactttcaccttatctgttcccagaagaagtgaacattcgtgtctggtctgatgtgctgactggtctgcagaataaataaaaacatccccatcttcatcataaaaagcaaccgcacattccggttcaagaaacgcatgctctgtccacggtgtttcaaaatgatgtgagatcacatattttgaatttcggattgcttcttctgcattacctctgctgatgtgcttatgtgcacagacattactgtcttcttcatcaaacaccttcggtgcatccagagccgcagcttcttctatagtatgtacatgcggcagtacttcatagtctaccttgatcagtttttttgctttttctactgtttccctgtcctttgccgctaccagagcaactgcatctcccagataatgtaccagaccaccaaccggtatcagcgtatactgatcatgttttaaatgtccgattttgttttctccaggaatgtcagcagccgtcacaactgcctccactcccggaagttcttttgctttggatgtatcaatagaaagtactcttgcacgggcatatctgcttcgaagagcagagccgtacagcattccatcgagataaaaatcatccggatattttcccgttccaagtactttttctgcaacatcaattcttgctacgcgatttccaatcgtccagtttggatctccgtcatctggtatctcaccttttttcaggatctttgctgcaagacggacggcatccatgatcttcacgtatcccgtgcagcgacaataattattacgcagcgcataacggatctcatcatccgtaggttccatattttcatcaagaagtgctttcgtacacattaccattccaggaatgcagaatccacactgtactgctccggcctttccatatgcataagtatatacctgacgttcccattctgtcagcccctctacggttataatttctcttccgctcagagaatccgtatccggtacacatgctttacatgtctttccatcaatgatcactgtacaggctccacatgcgccctcactgcatccgtcttttacagatgtcagccgaagttcatcacgaagaaatcttaaaagtttctgatttttctccgaacaaacattttttccatttactttaaatgctgccatagtggactactccttttcctgttctgctacagattgcatttacatcagcaaataagcatattgatcaatcactgtgcagataagctgcgcaaggcctttattcaaaatacctgacggctgatctgctcttacaacttcttctttttccccaatgcgtatttttatttctttattttttgcatccagtactgtaaatccattatttatactgtctttcatatcttcttcatttgcaaacaatgtaaacttatctttatatggagctcctgcatactgacagaacgaacgacagtttccacattcattgcacatataatccacatgaatgatctgcagtaattccatctccggtacttcgatcagtacatttgcacgatttggacatacatctgcacaatttccacagacacgtttgtgtactgtaaactctttcctctccgaaacatcttctttactcagacagtcaagcagcggggatttttcttcctttctctttcctgctttcttactgtttttctgataatttgcattttcaagtgcatctgccgccagtttcgttactcgctctacatgaacctctccgctcttaccgatctgacaggcagctgttttttctgcaatgcgtgtcatccatttatatccgcctggtttgagaaggaccgttgcaactgtgaccggccagattccacaatctacgatctgatcaatatttttctgatcagcacctcctgagaaagacatcggaagctttccatcaaaggattctgccagacgcgcagctacagaaatagaaagtggaaacagagccttaccagacatgtacatttcctctcccggaagttcctgtctcttgatatctaccggaaaggtattcgtcagcttcacaccaaaagaaagaccttcctgcgccgctacatccataagacgtttcagcattggcactgcatcttcatactgaaggtcatctttgaaatggaaatctgtgaatgccatatagtcatatcccagatcatccattgctttgcgtacaaattcatatccaagaagtgttggattacattttacataggtatgaatgtgtttttctttcagaagatacgtaacaatgttttcgatttcctgcggaggacatccatgcatggtggaaagcgtaatagagttacagatttctgacggaattgcctcaatgtcttctctggtcacatgttcaaaaagatccacatgtttcagaagccactccctgcattctttaaatatcgccgtatcaccggcatctttcattccctcgataaaatcatcgatttttttgtcctgaattccctccagattatagccgcacgacatattaaactggaatccatccggacttccaagtccaaattcctttgcgatcacatgcaggatcatccagccttttatatactcttccatcgcctgtggaacgtaaagttctgtggaccattcgcagttatatgcctcatcctctgctacgatgcatggtttcggaatacatgcggaaagttccggtccatccattttctgtacggtctttaattcaaagaatcttgctcctgcataataagctgccacaaggttctgtgcaagctgtgtatgcggacctgctgccggtccgacaggattctcaagttttcttccaaatatctctactgttttagaagggtcagctacatatgccttctggattccaaacacctgtccggtttctttatgttctgccaatatccattccatcagctgtccaaatggaatacttttcataatatcgctcataattcagttctccctgtaaaattcaatacaaaaaacaaataatttccaacatcagctgttaatatcatctgcaagttcttttgcagcccgacgacagtctgccataactttttcttcgtcgcagaccagtacctcacggtctttcataagcacttttccgttgcataccgttgtctgcaccatacttccgttcactccaaacagaagatgtccgttacaattcgaagcatccatcggtgtcagcggatcataatctactacgattacatctgctgcagctccttcttttaaaatgcccagagtttttttgaaataacggtttgcgatcttcgcatttccatcaaacagcatctgcggcacttcgctccatgctgcagtcggatcgcacagatgatgcttatgcagaatgtttgcaactttccaggattccatcatatcatgtgtatacccatctgttccaagtcctgtcaggattcctttatgtaccagttccatcgtcggaggacatccgcaggcatttcccatatttgattccggattgtgcacgaccattgtatctgtttctttgatcaactccatctcatgttcgttgatatagatgcagtgtcccagaatcgtctttggtccaagaatattccagtcatacaaacgatccacgatacgtttattgtgttctttcagacactgatgaagatcatagattccctcagccacatggatatgatatcctacaccttccggtttcagttcattgcacagctccattgtctcgtcagagattgtaaatgaagcatgcattcccatcatcgctgcaagcatatcactgtcctctttctgtacatgtctgataaaattaacattctccatcactgactcacgtgatttttccattccatctctgtctgatatttcataacagagacaagtacgtactccaaggtctttcgccgcttcttcgattgcactcagagatcctgtaatatggccaaaactggcatgatgatcgaataccgttgtcacaccgttcttgatcgaatcaatgtatgttgcatatgcagaaagctttgtctgctccagagtcagatggcgatcaatattccaccacattccatccaggatatccagaaatcccttcggagcatatccattgacacttaatcctctagcaaaggcactgtagatatgttcatgcgcgttaataaaagcgggcataatgattccgccgtgtgcatccacaaattcagcgtcaggataagtcttctttacttcatcagttacccccaccattttaatggtgttaccatccactgccactgctccattctcaataaaagcattggatgcgtcccgtgtaatcattcttccgtttccaataactaacataacgttcctccctgccttgtgaaatttttccaattatttgtgaaattttccataagttttcggtgttttatactatataatgtagcatattttgcatatcatttcaacctgattcgcaatttctttttggtattcaaaaaaaaattgctaattaaaaataaaaaaagacggaacacctgtatgctccgtcgctttactcagtataacataaattctgtaatctgaaaagtcataatattactgtttatttcttgtctccagcacctgaaggactctccggtctttcttccagagggccggctccagttccaccagatagccgcagccattaccgacatgccactcataaaattcttttttcggaagagcatatgcttccatgatattcatgatcgtacctccatgaacgacaagcgctgcctcagaaatattttccctgatacaggtcgtcactgccctctgaaatccctccagattacgtgccgcacattcttctttgctttctcctcccggaaatgccatgattccattgctgtcgatccatgcctggtatctgggatcatcgcttaactctttgtaattcttattctcaaaagcgccaaaatcacattccgcaagctggtctataatacggactttctgctccggaaaaagaatctccgcagtctcctggcagcgtctgagcggactcacaaatattgcctgtggtttcggatatgtaatatttttcagtcgttcgattccttctggacacagcggttcatccgtcactccaatatatctctgatgacggtttccttctgtcataccatgacgtatcagccagatcttaatcatgtttgatcaccgtcccgattccgcatacaacgcgtgttacttcatcactgtacgcagcaagttttgtacagattctgccaacagcctctctgtaggcgcggtcaaatgcatccattggtacaactccatatcccacctcgtccgatacgaggagtactcccggattacactggatcagtttctctgccagatcactgacatcctcattttttttcatttcagcacggataaattcatggaaattcacaactccctttgcattctgaatcgaattccagtctgcatcagcgccattcacccattcaatctccggatattttttttctgcaaaagccgccttcccctgaaaagcaccgccaatgatcatcttcatatgttctttcctcatcaaattttatagactactgtaataatcgccagaacaagcacaatccatacctcacagagacacaggaaatatccagaaagatctcctgtcgtcccaccaaaatatttcagagccttgtgccggtagaaccagaatacaagcagggccgtcacgattactgctgttccccataccggctggatccagaacataaatccggtgagcagcacaagataaataatcagtatattccgtactcttgtatcctgtgccttacgtgaaaattcagccactgtaccgcttgcatttgctttcggcaaagtaataacaccaattcccgacagacatctggacaccatataaccagttgccagaatatataacattttacgattatcctgttccacgatctgactcattccgccatacatagtcaaaaagtatacacatgctgtaatgaccgcaaacgcacctgcatgagaatctttcagaatctccagacgtttttctctgtctctccaggaactcagagcatcagatgtgtccagaagaccatctacatgaattcctcctgttacaattaccggtaccagtactagtgccactgcaataaatccattactcattccaaaataacggcagagccattccataccaagcatgaccaccccgacagctgcaccgacaaacggaaaaaagcagagcatataacgcatattttcttccgaccagtctgcctggggcatcggtatctttgaaaacatcgcaaaggcaatcttaaaactgttccacagacttttcatcatttacacttccttaaccctctccagaaaggagtttatttttatgatatacagggattccataaactacttcaaccacctgatctgctatttcagctatcttctggttaatctgtccgagatattcctgataaagttctgtctctccctgataatctgctgcctcagaaaatatctcattcgtaacgatcaccagatttcccgcctgttctctgatatgccgcacaccctttaacaccgcctcaacagtattctcatgtgctccttcttcctgaaacatctcatttgcaacaagattcgacatacattctaaaagcactgtacagttttccgggagccttatcttatcaagacctgtataacattcgactgtttcaaatccttttccctgacgcatcttccgatggcgctgcacacgtttcctgctttcttcatcaaaaggatacatggttgctatataaatcctgtctgtttttccaaaagaaacaacacaatcttccgcaaaagcagactttccgcttccgcttcctcctgtgacaagaatcatcatctttatacaagctccttcttatataagtacacttatccgtttttatttacaccagttcctcatactgttccacatgaatatcttcaaatgtgctcatggaatcatacacagcaattcccatatccaggaacggaaaaagtgtaaccgctccgctgccctcaccgaggcacatttccccatgaataacagcttcttttccgagagcttccaaaatcagacgtgcagccggctcctttgaaacatgagatgcgatcatatattcgcccgccagtgggcagatacgctgtgcgatcaatgctgcaacacaggaaataaatccatcgatcaccaccggcactccaagtgctgctccgccaaggaacatccctgccatacctgcaatatcaaaaccaccaacttttgcaaggacaccgatcgcatctttcggatcaggctgattcacttcaattgcttttctgattgcattgatttttcgattcagtccatctccggaaagaccggcccctctccctgtcatttcttccacagaacgatccagaagcacggatgctactgcactgcttgtagtcgtatttccaattcccatttctccggttgccagaagcccgtatccttcttctttcagtctgcgaaccatctcaatacctgcttccaatgcctgtaccgcctgtgctctcgtcatcgcaggtccctttgtcatattggctgttccataagcaactttcagctcttttgaaacttttgtatcaacagccattccgatatccaccggaataaccttcgttccacactggcggctcataacacatgccgacgtatctccggaaaggaaattttcagcaacgatcgcagtcacttcctgaccggtctgggttacaccttcttccaccaccccattatctgcacacattggtaccagagcacgtttttgaattttcatatccggattgccggtgattcccgcaatctgaatcaccagtttttccatttttccaagagaatgcaggggtttcgcaatactgtcccagcgttttgcggcaacatccattgcatttttgtccaaaggctttatctgagccagtgtttcttccagtgtcatttttatttcctccagatctgatctgtattttattattttcctgtagtaaatacaaaaaatttgctgaatacataattcagtgcaagtacaataaactgggtacagaatttaccaaccattccattcattcccattttttcgcaaagaagccagacacctccaacctcaattaccattgtcagaagacgtgcactgataaatttgcaaaatggccggatatgatcacgcaatgtctcacatttatcctgaaatacatattttgagttaactatgtatgcaaaaataattgccacaataattgatattacatttgcgatattcagatttaagtggcagagattccacaatatataaaaacataccagattcaccagtgtggtacatccaccaaaaaacacatatctgaccacatcattcccgtagcagaatgaaatcagttctttgatctttttcattttatttctcctgtatattacacatcatgtctgacactgcccgttacatctttgtttccacgcacgatctgtgacacaatatatcgcggacgatgtttcacttcttcatagatctttgcaaggtaataaccaatcacaccaagactcagcataatcgcacttccgatcagaagcagcagcaagatcgttgttgtataaccttctatcgcctgacctctgaaatattggatcagtgaataaatgatcatgatcagagaacacccgaaacagattcctccaccaaccgtaacaaactgaagcggagccgtcgtaaatgcaacaatgtttgtaaaagcatatttgatcagcgaccatgtagaccacttggactctcccgcttcacgttcatgcacttcaaattccacataggttgtcttatatcccacccatgaagatgttgctctgaaaaacatattccgctccggaagtgacagaatgctgttcactacttttctgtccatcatcttgaaatcagaagtattctgcatatccacttttgttgcttttgacatgattccatagaagaagccggcactttctttatgaagaaaactctcttctccccggctcttttttacaccttcaataacctcgtacccttctttccatttctggtacatttcaatcagtgtttctgccggatgctggaggtcacagtccataactgccaccacatcgccggatgcctgcgcaagtcctgcaaaaacagctgcctctttcccaaaattacgtgaaaaatgaactccaaggatattgggatctttttccccggcttttaatatttcattccatgtgttatcttttgatccatcattgacaagaaccagttcataagaaattccggcgcctgacaggacttcatgaagcacccggcaggtcttgccaaccatctgttcttcattataagccggaagtacgactgataatatactcatccttttttgtttcctcttttctttttgtaaatcaacaccacaccaatgtagcacaacagtcccgcacaagtcaagcagagccctgtatacagatacggtgtatgataggtaagccggatctcatgttctccttctgcaaggttcaatgccatatacatggtatttgcctgtttaatatctgttttctttccatccacataggcagtaaagcctgtactgtatggaagtgcgatcacaagtgctttcggttttgatacagaaatttttccggtcagttcatgatcctcaacttttacatcctgcagagattcttctcctagtttcttcacctgttcatccacttttgttacaggctggcagaccactttcagatcatcataagaatacactcctgtattctgaaatgtcagtgtaagtgaatttttccccatccggctgtatcctgcattgcagaggaaattatgttttccactgtatgcattatatttatctgtgtaaatactgattgtcttgtttaaaaactttccggtcacatcaatatacgctttctgactttccttccagtatcgccacctgctgttctcatgaaacacctgattctgttcgtaaattgacatatttttccattttttatcactgatcattgctctcggagaaagtgcctcatagtttaccccttctgtgatcaggtaaatttcactttcgtccagaccatcaaacaccagtcttgcctgcgcattttcttttgtaacgatcagttttccgtctttctcctgacagcctttcccggtaataattttaaacggaacttcacgatcattaagggtgagaactgtctccggaagtgaactttcatccagcacaactccctgcagcagtgcctgttgtttctcaatcacagacattttttcatatttttctctcggaatataagaatcatacgtatagccaaatggaagtgcattgtcacattcgtatgctcgatatgttttcccttttttctctgcctcgcccgccattttattgtatccataaggcagatattcctcttctcccgcacggacaacaaaatattttacagcagccagacgatccaggatcgttctgctgtccagattatcgtactgatcttctctcggcgtattcagatacatttcatcaaaaaaattactgatatttccgattgcgacgctgaaataatatgatgcactgttggttcccatctgcatggacgagttttcataagtatgcgttcccatctgatcataacgatacagcgaagaatcttctgtatctaagactgcaagatctgtccctgtctccagtttatccaatgcttctccctgctcagtgaattctgacagataatctttttcataagaatactgataataaatattaaacaaaattccggcgatcagaaaaacagacaccataatcgtaagatttctttttttcacaaaaaaagaaccaaacgacaatacagtaaacgttgctgctaccagaaaaattaccgccatcatatttcgctgtgtgcgcgccgcatcaggaagcaatgcaattccacagtatatgagaagcataacaaatatctttcttttttccttcagagtcagtgtaaacaattccggatatatttttacaaagatgtacgcgatcagcatcccatacgcccagatccatcgatttgagacataggaaaatccatttaacacatgtccggcataaggcagaagcaaaaaagcattcagcaatacaaatcccactttcaatgctgtatatttttttcgctttgaaaacagtacaaagacacccgtcatagaaactgcagtaaatcctgcaactccccactggatcatgttttctccaatcagacatccaagatatttttcataataaactttatcatataataacggaacatagttttgggctttaaaccggtctgttccaagaaccggaagaattaccggaagaaggatcactgctgcgatcaggactgcgattatcgaatacacaaaaaaagtcccaagccatcttcctatattttttaaggaacgatcctcaaactgttcaaaatatcgaactgctgcatagagcaccataaagattccgagcatataaaagaagtaaaaattcgacagacctgccagtgcgactgaccagataaaaatatatggtttttcttttttatatattttatcaattcccatcagtataaatggcagatagatcatcggattcgaaaagtacggatgtttcatggctgcataaatcgtccatccggcaaaaacataaatcatagatcccatgaatacagcctgttttgaatttttatgataaaaagcatatctgctgaaggcaattcctgccagatagattctcaaaaaaatcaaaaattcatacaaaaattctgtctgtgatgatttgaaaaataccgacagcaatgtcagcggatcaccgatcacataataatgtaatgttgtcagaatatcagatccatatccaatattcagatcccacatcggaattgacagtttatgttctataaacaaggtgtgcaaaatttttctgagatatcttccgtaatacgcaagtgaattcagatgctgaggaacaccgtcatgactccatatcagagatttcccattcaggtagaatcgcatatacagaaaaagggctattcctgcaaaagcaattgtataaagcaaataaaaatctgcatttttccatttgatgcgtgtttctttatgtttcattttactcatgctgtacctgtcctttttttctaaagaaaaaaaccgcggtacataaagtaccgcggctttgactctgaattattcttcttcgccgtacatagctacaagtttattcagatatgcatatctagcttttgcttcagattcgttcttagcaaacagtctagctgctttttcaggattctgacgctgtaaggagttgtaacgaacctcaccattcaggaagtccatatagttttccatatccggtgtcttggaatccagagcaaatttcttgtctgctgccgggttgaagcggaagttgtgccaatatccacatttaactgccagttcttcttctgtctgagcttttgccatacctttcttgataccatggttgatacatggagcataagcaatgatcagggatggtcccggataagcttctgcttcagcaattgctttaacagtctggttgaagtcagcacccatggagatctgtgctacgtatacatatccatagctcattgcgatggaagccatatctttcttcttagtctctttaccaccagctgcgaactgtgcgatagcacctgttggtgtagatttagaagactgtccacctgtgttggagtaaacttctgtatcgaataccattacgttgatgtcacgtccacttgcaagaacatggtcaacaccaccgaagccgatatcgtaagcccatccgtcaccaccgaagatccactgggatttcttggacagatagtttttctgagcaaggatctctttagcagcgtcgcatccacatgcttccagagctgcgatcagtttatctgttgctgcaccgttggttgctccaacagcgaatgtatccagccattcctggccagcttctttaactgcttcgtctttgccatctgctacaacagcttcaacttttgctttaaggccatcacggatagctctctgtgcaagaagcataccataaccaaactcagcgttatcttcgaacagtgagttagcccatgcaggtccctgtcctttagcgtttgttgtgtatggtgtagacggtgaagagttaccccagatagaggaacatcctgtagcatttgcaatgtacattctgtcaccaaacagctgtgtgatcagtttagcgtaaggtgtttcaccacaacctgcacatgctccggagaactcaagcagaggctgtttgaactggcttcccttaacagttgtttctttgaatttagcgataacatcttctttgatcggaagttctcttccataatcgaagaatttctgaagtcctgcgtttgcttccatgttttccatagcaagggcttttgcacctttcttgcctgggcagacatttgcacaggaaccacatcctgtacagtcataagctgatacagtcatggtgaatttataatctttcataccagtcataggaagagtagccattccttctggagcgttagctgcttcttcttctgtcagtgctaccggacgaattgctgcgtgcgggcagacatatgcacaacggttacactggatacagttttctggctgccataccggtacgtttactgcgataccacgtttttcgtatgcagcagttccggatggtgtagtaccatcaacatattctgtaaatgcagatacagggagtgtgttaccttcctgcgcattgatcttgcactggatgttgtttacgaagtcctgagcttcctgagcaccgtgagttgcatgagccatgaagagaccttcatcttctgcatctttccagctttccggaactttaacttctacaacctgttttgcaccggcatcgatagctgcccagtttttctgaacaacgtcatcacctttacgtccataagtagcttttgcagctgctttcatcagttcgattgcctgctcttccggaatgattcctgtaagtttgaagaatgcagactgaaggattgtgttgatacgagttggtcccataccagtttcgataccgatcttaacaccgtcgatggtgtagaatttgatatcatggttagcgatgaatgcttttacctgtcccgggagatgtttttcaagtccttccatatcccatgcgcagttaagaaggaatgtaccaccatcaacaagttcctgaaccatgttatatttgtttacataggacggattgtgacatgcaacaaagtttgctttgtggatcaggtatgtggatttgatcggtttcttaccgaaacgaaggtgagacattgtaacaccgccggacttcttggagtcataatcaaaatatgcctgagcatacatatctgtattgtcaccaatgatcttgatggagtttttgttagcacctacagtaccatcagctccaagtccccagaacttacagtttgtagttccttctggtgttgtaacaatcggagcacctgtttcaagagaaaggtttgtaacgtcatcaacgataccgattgtgaatttttcttttgttgtgttctcatatactgcaacgatctgtgccggtgtagtatctttggaaccaagtccataacgtcctgtaaagatcttaacatctttaaacttgctgtcttttaatgcagcaacaacgtcaaggtacagaggctcgccaagtgctcctggctcttttgttctgtcaagaacgctgatctgttttacagaatccggaatagcatcgatcagtgcctgtgcacagaatggtctgtaaagacgaactttaacaacaccaacttttttgcctgctgctgcaaggtaatcgattgtctcttcgattgtatcgtttacggaacccatagcgatgatgatgtgttcagcatcctcagctccatagtagttgaacagtttgtaatctgttccgatcttttcattaactttgtccatgtattcctgaactactgccggaagagcatcatagaacgggttacatgcttctcttgcctggaagaagatatcagggttctgagctgaacctctctgacatggatgattcggattaagtgcatggtcacggaatgcctggatagcatccatatctgccatatccttcagatcttcataatcccatgtttcaatcttctggatctcgtgagatgtacggaatccatcgaagaagttgatgaacggaactttacctttgattgctgccagatgagcaactggtgtcaggtccataacttcctgtacagatgattcgcagagcattgcacatccggtctgacgacaggccataacgtcggaatggtctccgaaaatggaaagtgcatgagaagcaagtgcacgagcggatacattgataacgcccggaagctgctcaccagcgattttgtaaaggttcgggatcatcagaagaagaccctgggatgcagtataagtagttgtcagggcacctgctgccagagatccgtgtactgcacctgcagcacctgcctcagactgcatctctgtaacctgtacttcctgtccaaagatgttctttcttccctgagttgcccactcatctgttgcttccgccataacagatgaaggagtgatcgggtagatagcagctacatctgaatatgcataagaagcatgagcggctgcatggttaccatccatggttttcatctttcttgccatagtttgttttcctccttaaaggtatgatgaaaatttttatttatttcagaccactgaaacggtctaaaagtccactggttattatagcatacactattgcgattgtccaatcgggattacgcattttctgtatctatttacatacaaaaaagttagccatttataagttttttcagggattttcgcttcagcatcctgcacagttcttcctgaatttccgcgagttcacagtgaacagaacagttctgtccgtctgcgctgttcctggcacagtcatagccaggttccaggcagtcaatgataaacattcccggatcgatcgttgtataaacatcataaagtgttatctgatcaagatcacagttcagagaatatcccccatgaacaccacgataccctctgaccattcctgatttctgcagttttttcaggattttgtatgcaaaaggtgctgtgatcagttctttttcacagatttcatttacgctgactctcttttcctctgccattgcgcggagcacccgcacagcataatcgcattctctggttatcaacatactctgtttcctctttccattacccgtaactctccagcaaactttcttaaattatagcaattcctctgtgtaaattcaatgtttttatgatttaaggcttgcaaaatctccactttactgtaaaatgggaatgaatggccaaaacaggccagttactgttcaatgatcgaaaacttaattcgaaaccataatgaagaaaagaggtaccttatgatttcagcaaataatatcactttacgtgttggcaaaaaagccctctttgaggatgtcaacatcaaatttaccgaaggcaactgctacggtctgatcggagcaaacggtgccggtaaatctactttccttaaaatcctttccggacagctcgaaccgaccaatggagatattgtgatcactcctggccagcgactctccttcctgcagcaggaccacttcaaatatgattccttcaacgtactggataccgttatcatgggaaatgccagactttatgaaatcatgaaggaaaaagaggcgatctatgcaaaggaagattttacagatgaagacggtatccgtgccagcgaacttgagggtgaattcgcagagatgaacggatgggaggcagagtctgatgctgctactcttctgaacggacttggcatcgaatccgagctccactatacacagatggctgacctgaccggcagccagaaagtcaaagttcttcttgcacaggctctgttcggcaatccggacattcttcttctcgatgagcctaccaaccatctggatcttccggcaatcgaatggctcgaagaatttctgatcaactttgacaatactgtcatcgttgtatcccatgaccgttattttcttaataaggtctgcacacatactgccgatattgactatggcaagatccagctgtatgccggaaactatgatttctggtttgaatccagccagcttcttatcaaacagatgaaagaagccaacaaaaagaaagaagaaaaaatcaaagagctgcaggaatttatttcccgattcagtgccaacgcttccaaatccaaacaggcaacctcccgtaagcgtgcactggaaaaaatccagctggatgatatgcgtccttccagtcgtaagtatccatacatcgacttccgtccaaaccgcgagatcggcaatgaagtgcttatggtcgaaaacctctccaagactattgatggcgtaaaagttctggacaatatcagctttactctcggtcatgacgataaagttgcatttgttggtgccaatgaacaggccattactacttttttccgtatccttgtcggtgaactggagccagacgaaggaagttacaaatggggtgtcaccacttctcaggcatattttccaaaagacaatacacaggaatttgacaatgatctcacgatcacagactggctgacacagtattctgaaatcaaagatgctacttatgtccgcggtttccttggcagaatgctctttcctggtgaagacggcgtaaaaaaagtacgtgttctttccggtggcgaaaaagtccgctgcctgttgtccaaaatgatgatttccggtgctaatatcctgattcttgatgaacctaccaaccatctggacatggaatctattactgcattgaacaatggactgatcaaattcccgggagttatcctttttacttcccatgaccatcagttcgtgcagacaaccgccaaccgtatcatggaaatccttcctgacggtaagctgattgacaagattaccacctatgacgaatatctggcaagcgacgaaatggcgaagaaacgtcacgtcttccaggttaacgaagaagatgctgccgataactagaatttcatactgcaattttgctacatgacaaaagctcccgtttttaatgatcgggagcttttgcagcttactgtttacagtattttttatttcattgtgatatccgccaattttccatttgtcactttcaaaagtgcagcaagcggaactttcagcgtcagtccgacgcgtcctccacttacatatatttcttcaaacccacccgcggatgcatcaaacacgaccggatatggttttttcattccaagcggactgcatccgcctcttacatagcctgtaattttcagaatatctttaacatggatcatatccacagccttctctccaactgctttcgcagccgccttacgatccacttctttttcgatcggtactacaaatacatagtatccgccgcttttcccttccataaccagtgttttaaaagactgttcatatggtgccccaatcagatctgcactgtgaagtccatcaataaactcatcacattcatatggaaatgcttcatatttcactttctgacgatccagcattctcatcgcatttgtcttagcttcttttgccatgttgtccttctttcctgccttctacccggcatctttactgttactttctttttttatgtgtatcatcacgtctggatatctttttccagagttcttctccctcccggtcgtcttcgtccatcatttctctcagcacttcctcatccagttcatcctcatcaattacaaccggttcttcatagtcatcattcattggatgataggaatcttctgtatcaaaagatcccagcggaagatcaatttctttctgtctgctctttctcggtcggtacggaattgttttttctgattcaggtgccaccgcatcctttttatgttttcttcctttatttttttcaagtctgaaatctacctgctgcgcactccgagatgctttatgagaactgttctgcgctcttcccggcgtatgcttcacattttgtctctgtgtcgatgttcttctgacttctttctgcgcctttctttctgatttctgcggcatataatcccggaaatccacataatcggaactgtcctgtccatcgttatacgcatcctcttcgtactcttcttcctcgtcatcatctttgcgcctgtttgtcgcaaactgaatcagcattccaagaagtgcaaatcctgcactcagtcccagaccatacggaatatccgccagtccgcctaattttgcagcagaaaagcctgccatcgcacctcccagaaggcttgtcccaatgatcagaacttccctcgcctgcttcatagccaacacaccaaggcccactcccagaaggagacagaaaaagaataccaacgaagtagttggatgaaaaacataaataccaagtccaattccaatgcctgctcccagaataaaaattccaatcttatagctcacaaatgcgatcacggccagtagtacacccgctccaaccataaaaaccgcatacatatatttctctgtcacaccaccggtatacgctgcaccaaatccaattccagctccaatgacaaaaccacagagcatcatccagaaacgcagaagccgatatcccagaatacagttaatcactccaaaaatcagcagtactgtaaaaccgatcatcgaaaaactggatatagacggtactgtccgcgtattctcaatcatattcataatctgctgcaaaatatcattcataaaaatatctcctctaaaacataaaatatatcgttttcagattatccagaataccataatgatactctactgtactgagcccatacattttcagataatattcagcaactttctgaacatatccttcctgtatccactgctgacatgcttcgtcaaaagcttcctgcgaagtaaatttgaaacgtactaccgcagctccgttctcaagacgcatacagcagaaatcataaatctgctgttcatcatatgtatcaaaacatgcctgattcagcacataaaaattaagatccgtcgcagtacactccggaaccggaaattcatcggatgctgtatataattgctcatattcctgtggaaaaggacacagataatcataaattgttgtcttatgttcttccagagaaaccgcaccgccttccagaaatgccggctgatccccgtttgtagcatctacataatattgctcaccgttaatttctacgatattccaggcatgtccttcatcaccgtccctcgcatttccctctacataaatacacggaactccaagctgttccaaaagatactgtaccgccctcgcatatccggcacatacagctttctttttccagaaaatgcctgcaatattctggtcatcctccgatgcttcatactctgcatgatctatcagatacgtataaactgttttgaccttatcataagcagacatatcctgtgtaatctgctctttcacttcttccagcgcatgttccatgaatgccataatttcctgaatttcctgatctgtatacgtatatccaggtgaaaatctgcaataatcagttcctttatacgcagtcgtatatacttcctcacgattgtgcacccagaaaagttccggatgatccttcagcaatgcatggtaaactttgctgatcagctgttcattcgaagatgtcagataaaactcatcttgtctctcctgtattccactcagcatttcacgatatattttcttctcatcttctgtcagcaatccaaaataatattccctgtaattgccatcggtctgcagaatctcctgttttcttaatgacctgacttcagcaggttcctgagaaagaagatcactctgccagatgacacccataaacaggacaatcaaaacgcagaaaactctgcgtccaaatcttctttttttcttcatctgtcactcccttatctcctgtacagtcttatattatcagacttctgccatcaataaaagagcttgctgtaaaaaaccgaacgactctttcgaatcgtccggccttgtttatcatcaatcttcaaaagtaacctgaatatcactgttatccggtttttgcggaagaatttccgcagaacttccggaaaccgaaacattctgattcaggatttcatccagcgtatctgtcacttccacactacccgtcgcataattggaagtcgtctgattttcggattcatcactcatatcctcaaatgttatctcaacatcctcagccgcatcagcaggtgctgtaattgtttccgctgtatcatgtgttgctgtatccttcacattcaatccatcactgagagagtttgttgtttctgccacaagtgttgctgacgttgttatattatccgttatcagatctgtttctgcattgtctgcacttgcaccctggttttccatctctgcaacttccgtctgtgtaggatagaaggaaggttgacggatataacggaaacttgcaccataagcttctccaactgttactccattcttactagaagaacagtgtactgcgatccagtcgcctgcctctgtcttgccacagataatacctacatggttattactgcccgcttccggtccattctggaatacaaggtcacccggctgcgcatcctgttcactgacaacattggcattctcccactgttcagaagtaccgtctcccacactgctctgcataccctgattcagatatccattgatcactgaccatgtaacaaatccactgcagtcaagaccatatgcacggacagttccactgctggcgctgcctgctgcagatacttttgcggcagaaccccaactggagtctttaccgatctgcgttgatttgccgccccagaaatatccaacttcacctaccagtgaatatgctgcagtaatgacatttacacgttcttcagaaacatcatccccgacactctgacgtacaaatcctttcgcatctgtaacgatcgcacagagcagcttgcaatctgtttctacatatttcttaagtactgtcctgttttcctgtgaaatattattctgtttaatataatggttaatgtgatattttccataagaaacatgtgtaatgctttctttatcacggacaaccggattcatctcagcaaagatctttgccagttcatccttcgctgatgaatcaagagtgaactccgtgtttccttcctggctctgctcataaacatagattgccaagatatcctgccagttacgcacgagcagagaatctgctgaagtcgtcaggccgtcagctctgctgtcgctaacgtctgtcagtttgtttttttctttatattctttttcaatttcatccatcacagaagaaaaatcatcagaaaaagaaagctgataattatttttcaaactgtccagataaaattctttgcctgcatgaaggttcgacacataataaaccggtgttcctgtcttgcctgtaacatttccacttccatcagaaatatctgttgcattccccgcatccttctgattcttctgcaattctgcaatcttgctttcaaaaccaacaagaagatcgtaatttgtaacaaacttcttctggtcttccggcaggctgtcatattctgctctgagttcttttacccttgccgcatgatttactgtaagtgtctccttcgcaagtgcattgatctttgctaccagattctttgcagcttcagattctgttacatttgtcggtgccggactcggtgttgcagttggatccgatggtgtcacagtcggctccggtgttgcagttggattcgatggcgtcacagtcggttccggtgttgcagttggatccgatggcgtcacagtcggctccggtgtcggcgtatctggttccggtgttggtgtatctggttctggcgtcggcgtatctggctccggtgccggtgtgtccggttctggtgccggtgtgttcggttccggtgccggtgtgtccggtgtatcacttccatcagagattacctcaccacttccatcgcccaaatcgcttgcagtttctatatgctcatccgcagccatgactgacatcggactggataaaaccattgcagataaaattgttacacataaacttctggtcagatatttgttcttcattctggtaaaattgctcccttctgtcaagaacatatctttattccccttataaaggtatgtttctcactgctaactcacttacacaataactgtggttagtttagcataaacttccataaaaatcaaccgccgggataaataccccgacggtttctggataaaattcacattcttttcatatttacataactgcataagcataatctgctatgccattcttcctgcataactgaaacagtccctgaaatacctgatagcacacagtgaggatataatgaatatcatcatctatatttctcttacagttcagatatctcctgtgatgttccttaatgtactgtagaagctgattcagcgtctcaaaatggattttcttctccgtatacacatcagccttaccttccagaacaaatgctttcagctcgttcttcagatgcttttcataggtgttgtgctgataaaatgtaccatcaaacgtcttattatgtggaaaagtaaaataatctgctatataatgcatgacctctccggatctccgccagaataccctgtcattatacccggcccctgactgaaccagtcgtcgtatcttaccctgaacctcatcaaaagtaccgaaatactcatgtctcttggttacaaatgaaggctggatgtctggcaggatattgccaagacaaaatgcttttctatgtgactgtaaactttcattagccggcatctgatctgccagataccttgccaataatatgtgtgatttcttacgcacaataaacacttctttctctgataaaaaacagtttaccgtaaccatatctactatagcagatttacttttttaattcaaataaagtttttataaaatcctgacactttttggtacaaaatcatcttttcaagacaccaagcgccatactgtgctgcgcagcatgtcttttttcaaccagtgttcttggatatccaactactccgttgttatcatatggatcattaaaataatacttttcttcatcatatcccaccagtagcatacaatgttcgttcgaggtccagcaaaatcgttctcctgtatccagaagtttccactccggtcccggaatttccttacgcatgttgatacatgcccagaataccaccggcatatcctgatcgatatactttttcagaagtgtctctgtcgatgttcccgtctcatccagaaattcataatgatcccctgcggcttttgcaagcgctttctgaagtcctctcgcataaatcccataagattcttcatcataaggatttccacagaaaaatttattcggatccggaccatacagaacaccatcccgtatttccatctctcggcactcaagacagttctgaataaactcatctaccgtaatctcatagccaagatacttcaataacataactgccgaaacgctctcgcatacagttggatattttatgctctggtcaatatatggtacctgaatcttacgcacttgcttttgtctcctcttctttggaagatgtgatttttttgatcactgtaagcgtaagcagaagcaggatcaggctgattccaagaaccacccaccagatatgtacaaatccggcaatgatatacccgataaaggagatcactgcaactactgctgcatactgcatctgcgtagttacgtgattgatatgatttgactgtgcccctgctgaagacataactgtagtatcagaaatcggagaaacatggtcaccacagactgctcctgccagaactgctgatacagaaatgatcatcatctgaagattttcagaacccgggaacattgcgatcgcgatcggaaccaggattgcaaaagttccccagcttgttcctgttgaaaaagaaaggaacacagcaactacaaacaagattgccggaaggatcacacttgcagatgcattacttccaacgatatttttgacaaaagtactgatttccagtgcatcgcccatgcctttcagtgaccatgcaaagatcagaattgcaattgcaggaatcatcatcttgaatccctctacaaagctgtccataaatcccttaaaggtaaccactttgcgtggaagataaagaatcagcataaaaaataccgtgatcatcgtagcaaagatcaagctggtctctgcatcgcaaccagaaaaagcagtcacgatatctgttgctccaccaaggaatcctgtatagatcattgccccgattgcagatacgataagtaccagtaccggcagcacaagatcgatgacttttccatttgctgagatttcttcgtctttaacctgatcaaattcctctccacctgaagtaaaaagatctcctctggccgcattgcgttcatgtaccttcatcagaccaaaatccagtccggtcatgatgatgaaaactaccatcacaagtgtcagaatcgcatacagattatacggaatcgttgacaggaacagctgaaatcctgtaataccagcatcatccggcacataagaattgacagctgccgcccagctggaaatcggtgcgataatacataccggtgcagctgttgcatcaataatatatgccagtttggccctggataccttgtaacggtctgtgacaggtctcataacagaaccaactgtcaggcagttaaaataatcatccacaaagatcagtatgccaagacctgtcgttgccagcattgcacttttcttagtcttgatcttacttcccgcccatttgccataagctgccgatccgcctgattttgacatcaggacgatgatcattccaagcagtacatcaaagatcaaaatattcagattcatactgttcttcatgatatcaaagaatgccacaaatgcattccacggatgaaagccggtatacagcagtgcccctgctgccactccgataaaaagcgaactgtacacttccttggttactaatgccagcacgattgccagcaatggcggtaccagtgaccaccatgttccgataaacatcgaaccatccatttcattttccccctgcatattatattttcaatgctttaaatctattatacactaccatatttgtcctgtacaccaaaaaagtgcgaagtccggtggaaatattctccaggtttcgcactttctttataatattctttaatccatcaaattactcggcctttttactcaaacgaaatactgtcaaaatccggtgttcccatcaggtcaaacggagtactctggtatacgtaataattcagccagtttgtatacagattattggcatgagctctccagagaagcagcggtctgttttccggatcattatctttgtaataattcttcggaagatcgatttgaagtccctttcctacatctctcttatattctccatccagtgtcacacggtcatattccggatgtcccatgacaaaaatcttacgtcccccctgcgccattgcaagaaaaagccccgcctcctcagattctgcaagaatcgtgatatctttacatgcacggatatcttcgattggaacctctgtatgtctggaatgtggtgcaagaaaagcatcatcaaatcctctgaccagcgggatcttacgattcagaactttgtgccagaagagaccaaacattttgtgatcgagctgacgtttctgaagtccgtaaaaatgatacagacttgcctgtgcagcccagcacagaaaaatcgtagatgtcacatgactttctgtccagtccatgatctctgtcagctcgttccagtaatccacttcttcaaactccatctgttctaccggtgctcctgtcacgatcattccatcaaacttcatatctttgagttccgaaaaagtctgataaaatttattcagatgattggcagacgtattttttgcctgatggctctcaactgccataaaagtcacgtccacctgtaatggtgtgtttgacagagaccgcagaagctgcagttctgtttcttctttcagaggcatcagattcaggatcagaatctgaagtgggcgaatgtcctggtgtaccgctcttccctcatccatgacaaatatattttctctttcaagaatttcttttaccggtaaatctccctgtatcttaatcggcattttctgttcctccttttgtccaattacaaatttttcaagaatcccgccactgatataattttgttgctcaccacctgcagaggtggagtcatctcatatctgatataatcttttatctttctgccagtttcaggaaatcttcctctgacagaatcggaatcccgagttcccgggcttttttattttttgatgaattcgaagtcacatcattattgatcagataatttgtattacctgtcaccgaaccggttactttgccgcccagtgattcgatcagatttttggcttctcctctgttgctgaaatgttccaggcttccggtaatgacaaagttcattcctgtaaagatctgctcaccggaaatttcctctttattaatatggagatatttcagcagatgatctactttttgattattctccggattactgaaatactttgtcagactctttgcaataaccggtccaattccatcaattgcactgatttcttcttcatctgccgaacggatcttgtccagattatcatcaaaatgacggcagatcacttttgcattggaaagtccgatatttgcaatcccaagactgtagattacttttgcaagtgttgtttcttttgccttctcaatactgtttatcagattttcgtacgacttctctccaaagccttccatcgttacgatctcatctcgatatttttttatctcaaaaatatctccgaagttgtgtataaaaccttttgcaataaatttctccagcgttgcttccgacagtccgtcaatgttcatggcatctctgcttacaaataaagtaaatgccttaatctttttggccgcacagtccggattcatacagtaaagcgcctctacatcattttctctgatcactctggcttcctggccgcatgccggacagatttccggtatttccagcttactgcttcgggtcagattctcagcaatctgtggaatgatcatattggctttatatacctggatcgtatccccaattcccagctgcagatctttcacgatactcacattatgcacgctggcacggctgactgtcgttccctccagttcaaccggatcaaatatggcaaccggattaatgagccctgtccttgaaggactccattcaatttcacgaagtgtcgtctcccttacttcatcggcccatttaaaagcaaacgcatttcgtgggaatttcgcagtacttccaagcgattctccgtaggtaatatcatcatatagtgcaacaagtccatctgatggaaaatcattttgctcgatcgcatgcgcaaagtaatccattgcttcatccagattctctcctgtaaccatacgatattccaccacttcaaatccctgttttctaagccattccatctgatattttctggaattatgcatatctacatcctgtgcagaaaccagagcaaatgcataaaagcgcacatttctttctgccgtgatctgattattcagctgtcggaccgaaccgctgcagagatttcgaggatttttgtattttgcatcgacatcttcgatcgtatcattgatcttttcgaaatcagaatacgtaatgatggcttcccctcgcaggaccagtctgccccggtacgcaattttcagcggaatgttcttaaatacttttgcattatttgtaattacctctcccacgataccatttcctctggtaacagctttaagcaattctccattttcatatgtgagaacgatcgtaagcccatccatcttccaggaaagcaaagttggatgtgtcccgataaacgctcttaaaacttctctgtccttagtcttatccagcgaaagcattggatactcatgtgtttcctttggcagtgcatcgaccgcctcataccccacattaacagttgggctgtctgccagaacgattcctgtttccttttccattttttccagttgatcgtacagtgcgtcgtactctctgttgctcatgatctcccggtcttcctgatagtatgcctttgccgcttcgttcagcttctgcaccagttcttttatttgttctgccgctgatgtttccatgctgtcctcctgttctgattactgtctcactggaagaatcccgtatcagttcattcagtttcttccattcatctccacgtatttcccgatactctccacgtttcaggccgtccagtgtaagattcatgatacggatacgtttcaatgtacatacatgatatcccagatattcacacattcttctgatctggcgattcaatccctgtgttaatatgatagaaaagcttttatcactggtcttatataccgtacatggtcgtgtcacagtccccagaatcgggacaccactgctcatctttctgataaaagtttctgtaatttttttgtccacggttacttcatattctttctcatggtagttacctgcacgcatgatacgattaaccaggtcaccctgattcgtcagtaaaagcagtccctctgaatctttgtccagacgtcctaccggatatactctcaccggataatccaggaactctgttactgtcgtttcctgtcgctgcttttttgtactgcacacaataccccttggcttataaaaaagcagaagtacctgcctggtctctgccttcaccggtctgccatccaaaaaaacctctgcatctgctggaatcctttctccagtaccgatttcttttcctgcaaccgtaacccgtccggcatctgtcagctggtctgcttctcttcttgaacatactcctgccgcactcaggtatttatttattcttattgtagtctgatctgttgttatccttttttcgtccattattctattatatagttttttctttttgtccgcaaccgagaccttgtttttttttaccacatattgtatgataaaattattgttttatcatttcagatacacaaaggagggaaattatgtctgataagaaacgacacctgaatcccctgctgcttctgattgcgattttattgtgtctgtctgcaggatttttattccgtcgaacttcttttgatgcgaattacaaaattcctgccagacattcctctgtaataaaaaaatccaaggtcacaccaacgcctgttcttacccagaaaccaaaggcaaacgtcagcatttctgctacaccgaccattacggtcgagccttctgtctctccttctgaatccatatcacaagatgagacatccccggaggcaagccttggagtctggacttcaagcggcagcaactggatgtttatggttgacggtgttccttacacaggctggctgatcgatactgacggcaaacattatttctttgataaagatggtatcatgcagaccggatgggtggatgataatggcaaacgttattacatggatctggatggtatcatgcagaccggaacgatcacagtagatgatcaaaattatgaactacaggcagacggttctctaaaaaaataagcattgaaaaagacacaggatccatcccgtgtcttttattctgtctaaatattttactgaagcaatccactgtatacatatccggtctgaccatcatattcaatctggatccagtcaccttcctgtcccattttctgaacctgatccccttcgtcaaggccgccaataatttcactgtcactatttgcttcagctctgacattacacccttctgtaactgtcagcattgtgccgtctgcactcgtctcagaagaagaagtatctgcttcttcacccagtccgtcaaggaactgtgcaagagctgtgtcatccttctgtgcctgctcatattctgcctgcacctcagctgtaagcttctttacatcttcatcagatttcagcgaatccatataagtggaaactgttgtgttctgttcaaggtcacccaaaattctataggtaccatcgctgtcttttacaacataagaactccaaagagacggtgccggtgtatcaatccccttacagatgaaacttcctttcgtatatacaacatacgaattgtcgtccatccctttcttcatatacactttgctgacttgatatccttcaatataatcctttgcatttgtgattctggattcatcagaaggtgtcagattatttaccagtgttcttaatgtcgtaatatctttttcccctaaagccttgtagtagctgttcataagtgcagtaacttcttcactgccatcctccaagggattcgtgtcttcttctttcttcccgtcgtttgtctccccatcatcttccggagaagaaggatcatttccctggctgttgtcctgtgctgtagtttgttctccgtccgaagtcccctttccacttccggtacaagcacgtatgctaaagaacaatacagctacgattatcaaaatcaccccgccaagcataaaatagcgaaggttatctgataaccattccctgaaattatccaagttcttgtcctccttaattattactgttcactttgttcacagtaacttacaacgcaccgaggcagacccattacctcgtgcaacacacctgaagggaatcgaacccccgcacatggtaccggaaaccactgctctatccactgagctacaggtgcaagcttttcctaaagctttttataatatagcacatatttgagtatttgtaaagtttttgaattattcccactttttcaactattaattcagaatatatgcatttttgttttaatactacgatttatactactttccagacacggtagttttcggtctgtccaagcacatacatagtcgtccccgacagatactcatccagctccggcgttgcggatataatataatccactttacttcctctgaccaaactctgaaattcttctgccggaagagaataatcatgataataatagactgctacaatctttttcatccaatctttgatctttttcttcttcataaatttttcttcggaagttttttcaatcttctgaagtatacgacgactcacataagatctcacatccggatcatactgtctgtaaacaagaagcagtccatcgctcagtattcttggctgctcaattccttcactatgtataatactggaaagatccagaatctcctgtccaacaaaatacgcattggttgcctttttatatggaaaatcttctgctcccctgaaaacaggaattcccagtgttacgatcagcacaagacagattccacctgtcagaatccgtacccctgtttttgcagatgcaaaaataagtaaagtcagagcataacctattgtaataaagaagacaatgatccacagaaatctgacaaaacgtgttccaaatccaaatacatccagaaggactttcacgacaaacggattaaagatcgtaaggcattctgttacaaaaacaccgataaataattttcgatctcctttttttccaagaaaccagattaggatcagcgccaccggataaaggatccaaatcggattgtttcccgtataggtctggagggactgtatcagaaattgtattgtttcatttaaattttccaatcattcttcctccttttataccaaatggctgagcagcatccaaaatactgacggcagcaacacaattatatatcttttcagcagatgccactgtcttttcagtattccatcacataaaacatacggaaataatgtagctccgatcatgcatggcacaataaacagcgcagaattactgaacgcaattccacctgttccacacagaaacagtccgcaccatggccacagactcgtctcctttctgtatattgccagacagaatccaaaaatcacagtcatatacagatatgcaatgattgcttttccttcataggttcgatatgcaaaatactgagaaactccaccaagactgtacgaaaacaaaagcaccagatctgccagtatcacaaacactgttttttctgcttcctttttcttaaaaaatccatttgcacactggtacagtcccatctcaaatagaatcaccatcgcaatcgtaaagctccatttacgttccataagtggatgaatattcagtacctgataaacaattgcactctgcagcgtatctgtattcataatatagaactgttccggtgcctccaacagggttcctgaataaggtgccactctgtccagtgtattagaatacacggatgctaccggcagtccaatataattgtttgaatcatacgttgacagtgtattggtattaaatccaagcaacactgcgaggcctactgctgccagcaacagaataaacacggatatattcttttgcgtactgcccggtattgtcctgacactgtctgccagaactctccgtcttttccatattacaaagagaaagagaaggatcagcaggcatccccagattaccgtcaactgtttcagcgaacagcacagatatttcattggaaatgccacaatttcaaacagagtataataaagcaaaaatccggtaatacacataaccgggaatttccctgactggaacttttccgggatcagtgtgccaaacatccagaacacaacaagatatccccccgccagcagggttcccattatcatatttgtcatgaattttcgttggttcctttctttttcagaattcccatcgctattttttcaggtgtgatcggaagttctcgaaaccgtactccggttgcattataaatagcttccgcaagcgccggacatggtgtatcgatcacaagttctccgatagatttggctccaaacggtccactctcttcataactgctttcaaaatccacccggatctttccgatatccattctggttggaatcttatactgcataaaggagttatttcggatttttcctttatcggtatactgtacgtcttcaaaaagagccataccgattccctgcgcaataccaccttctgtctgtacacgtgccagatttggattgattggggtaccacagtcaacaactgccacgtaatccagcacatctacctcacctgtctccgtatccacctcaacttctgccataccaaccataaacggtggcggtgacagcggtgaagaatgctgtttgaccacctgcagttcaatgttattaaagaaggtacccttcaacgccacctggtccagagaaacttttttctcttcttcctcatcctcatccacaaatacatacgaaccgtcaaacgcaaccttatctacatctgttcccaacatctgtgcaccaacttcacatattttacctcgaagctctttgcaggctttcatgactgccacacctgtcgtataagtagtggaggatgcataagatcctgaatcatatggtgaaatatcagtatctacactgaatacaacaatgttttccatcggagtttccagacagtcagccgcgatctgcgccataatcgtatcacagccagttcccatatccgtacatccaagtgcaagagtatatgaaccatcctcgttcaatttgatatctgcaccgccaacatcaacgccggcaatagaagatccctgcatggccattgccactccgactccacgaactttaccatttcccatatcacggaatggatacttggaatcccagtccatcatttcttttgctctggccatacatttatccatcgtacaactctgtgcataaggtacatccggataacccggaagcggtccaccttcaactggcatgtttaattccttgattcttaccggatccattcccattttgtgagccagctcatttactgcagattcaacagcaaaaattccctgtgttgcaccatatccacgataagcccctgctgcttgcacattcgtataaacaacatcaaatgcaaaacgataagcttctgtgtgtctgtaaaggccaattgatttgtgtccgctcagtcccactgtagtagaactgtgttcaccataagcccccgtattagacaacgtatagacatcaattgctctaatgataccattttcatctgcacctgcacgcacggtaatttccatttcatggcgtggtgaggagcagatcatagattcatacctggaaaagatcatcttggacggacgaccggtcttccatgtaacaattgccggataaatttcactgacggaagtctgttttgctccaaatcctccaccaattcgtggtttgataacacgcactttggaggccggaatatccagtgctcttccaacaattcgtcttacgtggaaaggaatctgcgtagaagaaagtacgatcagtcttccaaaatgatccatataacaggctgtacggaaggtttccatcatagtctgctggttcgctctggtatgataagtatgttctactgtgtatttgcattcgctgagcaccttatccacatctccatgctcttccagtgcagttgcacacagatttctcttatggtctccaccaagcggaatctttagtttccagtcttcttccggatgtacaagaatcggattatcttttgctttatgcatatccaatactggtgcttccactcgatattgtaccttaattctttttaatgctttgtctactgcatcttctgtctctcctgctacaattgcaaccgcatctccgataaatcgaacatgacgatccagaatcagacgatcatccggactcatttccggtgcagtttgtcctgccagagtaaaacgcttctgtggaacatctttataagtaagaacacatgcgatacctgcaactttttctgcatttccggtcttgatttcttctacccatgcatttgcatgcggacttcttaatatcttaacgatcaggcagtcctttggtgccagatcatccgtataaactggttttcctgtcaccagcgacattgcgtctgttttacgtacaggctgatttacatatttcatttttatgcgtcctcctgtgcttttttatattttaaaaacttgaggatacttgttgtctgagaaacaaacccggaacatctgcacagatttccggcaagatattccttaatctgttcttccgtcggctctttgatctcatgaagcatggcaaatacattcataataaatccaggattacagaagccacactgttctgcgccctcatttgcaagaaagctcccgaattcctgtgcttctctctgcattccttccatcgtcactacttttttcccatcaatacgagcagccaatgtggaacatgaaagaatcggtctgtcttcaaccagcactgtacaaagtccacaatttgcagtttcgcagcctcttttgacgctgtaacatcctttttctctcaaaaaatcaatcagcaacattccaggctcaatttcttcctgtcggtaaactccgttcagccagaaactaatattcattcttcattcctcctactgcttcccaggttcttcttatcaatacctttaccagaagagtcctgtattctgcggaagcccgcatattacctgccgtagtcacatgttctgccgcatattcagcaaacttttcaatcgcttctgtgcgctgtttgttggtcatatgcttgaaatttttaaggatactttccttatcttccacaacaaccgcacgtgccggtcttgcgccaataacagttctcgcttcctcgccgatcagcgacgccgtacaagtcagtaccggaaaatccgtctttgaatttcgctgactcatataacagacaaacaacggctgtttacgtacaatgatattcacaagaatatcattatcttttttgcggtttacaaattctgtcagtggaattcttcctgcatcatacaattccacccatgtatccattgccagaaacattgtcagtacatctgagaatccataccgtccccagatacttcctccaattgttgcacagtttcgaaactgtacgccaactatatgacgcagactttctctgactgctccatgtgtatactcattcagtctcttatttatttcaagttctctcaacggtgtcatgcagccgatcacaaactcatcatctgtttcctgcactgtatccaaccccaggccggaaagatcgattgctgtagaaatattacgatttcccatcttcagccagaccataccgccaagaaccagtgctgtttttttctgattcagttcatacgcttctgcaatgctttttactttcacatagctcttaatctttagcatctgtgtaccgattcctttcttctcatccaaacttcaatatgtataggcatacgttatctaattttagcagaaattttttcatttttccatagaaacaatttattctgtgaaacatgcataaaaaagccctgtccctgtcaacagtttttacaactaactgttgaaaaggaaagggctgttctgattatgattatcggttgttgattgcagttaccaacgcatcaatggatgcacgaatgatatccggatcaacgccagcaccccaggaaagtgttccgtccggtttctggatacctacatatgcgattgccttggaactactgctcttttcgagtgcatgctcctgataggttaccagtgtaaatttcatttcgtatgctctcttcagtgcattgctgactgcatccaggcgtccgtttccggttgcctctgtagtaatagtctttccgttaaaggtagatattacctgtgtcgtaatgcctccatctttctgctggaaatgcacttcattgatactatatggttctacaacattctcaaatgtagatttaaacagattaaagatttcatctggatggagttctttatgactgtgatcggaaacagcttttgctgcataccccatagcttcacgcatcttaggtggcaggttcaggccgtattttgtttccaggatatagccaactccacctttacccgactgactgttgatacgaataacatctgcatcgtaatttcttccaacatcagtcggatcgatcggcagatatggtaccgtccagcgattcggatctttttcatctctccagtgcattccttttgcaattgcatcctgatgagatcctgagaatgccgcaaataccaatgctccactgtatggacttctttcatccactttcattccggtacatgcttcgtatacttcacagatatgtggcatatcagagaaatccagttccggatcaactccctgtgcaaacatattcatggcaagtgtcactacatccacatttcctgtacgctctccgtttccaaacagcgtaccttctactctgtctgcaccagcaagcagaccaagttcagaatctgcaacgccacatccacggtcattatgtggatgctgagaaagaattacattttcacgatatttcatattctcactcatgtattcaatctgactcgcatacacatgtggcatagacagttctacagttacaggcagattaatgattgccttattctccggtgttggctgccatacatcaagaactgcattacatacttccagtgcatattcaggttctgttccggtaaaactttccgggctgtattcaaactggaaatttccctctgtttcatcagccagttctttcagaagcttggcaccatcgacagcaattttcaggatctcttcttttgattttttgaatacctgctcacgctgtgctacagatgttgaattatagacatgcacgattgccttcggcgcacctttgaccgcctcaaaagtcttacggataatgtgttctcttgcctgtgtcagaacctgaattgttacatcatccggaataagattctgctcaatcagtgtacgtacaaatgtatactctgtttcagaagctgccggaaaacctacctcaatttctttaaatccgatttttacaagaagtttgaaaaactcgattttctgttccagactcatcggaatgaccagtgcctggtttccgtcacgaaggtctacgctgcaccagatcggagctttgcccacatattccttctctgcccatttcatacatttcattggcggcatataatactgtctctggtattttgttacgtttttcatgttttttcctcctgtttctctaacatataaattctctgtatgttttctgtttctgaacaaaaaaaaatctctcatctctacagactgctgtaagagacgaaagacatctgtcttcgcggtaccactcttatttatgaacggttcatacactcatgggatacggaatattttgtataattcttatatcctctccatataacggtggataccgtctgcgcctactttccagatattcgggagttcgaacagatgctccaaggcgagttccatgacttctttctactgtctcacaccatccgacagttctctgtgctccggtcctcatgtactattcctcatcaaagcattttgcatattttgtcgatgactaaagactaacatgtccactgctccttgtcaagagtgaatttttgtctcagtctttctggttcaatcggggcaacaggatttgaacctgcgacctcacggcccccagccgtgcgcgctaccaagctacgccataccccgatggatgttattataacaatccgttttttattttgcaactattttttagattgagagagggcagatgcccctctctcatgataccggaactatatttgtaactacatctgtatgactgtaacgatcataccttgttttcttattcttaaaagttaacgcagcttttctctgcgccatgcttatcgaaacaattcctgttttatcagaagcggtcacattggctgtatccggtaaaatatactcaaactgatagcgcaatgtcggcaactcactgaccgtatatgtgcctggctgaattccggtaaaagaacatttcatcactgcatcttctcctgccattgcatattttccaggtttaaattccacatatttttcataaacatgcgttgctcccaactgatcttttcccgttattctgaatcgaaataccgggtttccgtgtgcccatgtgatatctgcttctctgattctttttgtcacagtgatctcgccatcagtaagcactgtatttccttttacccacgactgatttgtattctgcgtgtcctgcatcctgtctgaaacaattgttctcgatgccgtattttcaatcgcataaaactcattcgatctctgataatgattatgcgaatcaatttcctggttgcttcctgcctgcacttttatcctgaaataatacgtcacattgttatatgcttcgtctgttttgaggaaattagaatcagcacgaaaaacaatcgtattggaacgattttcaatattaaagaaacgtgtcacatcatttcccagtgcagtcatgacactggcacttcgatatttcaggcaggaatccagaacatctttcaattcaaaagagctgtaatttcccggaagaagctgctgtctgatcacataatcaaagttttttccctctgcgatctcatatgccggatcattatctgtgaatgtatgccttgccatggactcaaaggaagcattttcatctccaacccttttttcaggtcccggattcggttcatagcttccaatcgtctgccccgttgaaaggtaaaatgcattctgcgcgcctgtactgtttttccatgaatcctgggccagccagttgataacaaaagagccattaaagtccagctgacaccagccctccacatcatctgtagttatatttcctccatctgcttttccgcgtatctcgcgaaatgcatttccatttgctgtcgttccctctgttgctctcagataatcataaccactcctgaggtatatatgatcaacaccccagctgtcatatgtccggattccctgcccactgtccagatctactgccgttatatgtcctttgggataaatctgcacacttgtattatgattcaggaattcaaactgaaatcttaccgatccaactgaaatggtattaaatgcaattctgtctttgtaaaacagcacacatggtgtaatctttgttttgtcttttccgacatgaccattgttcacggttccccaggccggtacggtcactttcagatctacgatctgtccctgatactcgcctacattgctatagattactgtaatggcatccgtattacttgtattaccaattgcgcaggcataaaaactctgacaatattctgtcgtatatcccttattgtctccaaaccagttgtgtattttattgttcaggctgtcgttttttctgcttatataagaaagctgtgtaactccttttcgaaaagcataggtaaaagcatattccggtcgcattttgtaatttggtcctacccattctacgggaataccacttcctgcatatgtagcaattgatttttcattatccatgaaaagatcttcttctcccatttcagcattcagttccagctcctgttctggattctcttctacttcagcctctatgctctcctgttcttcttcaaaagaaatttctgtctcttcttttacttccgatggatcttcctcaacctctgtatcattttcgggcgaatcaactccttcattttcagtattttcttcgttgtcttcagatgtcgaatcatcaccatctttcatttctgtctggttttgcgaaatatcatcttccacaccatctgcctccatactgttttcccacagcctgtcttctgcagatgcctgaactcctgccatcgcagaaaatgtcagcaccgaagccaatatgattcccgctatttttttcttcatgattcgtttcctcctttaaagcatctgatacacaaagtgatcgctccggaacccagaagaagaatgagaagtaccaacggttcagaatcatctcctgtcctgacgggattttttctccgtgtttttatatctttttcttgtgcaactccaccagcactctcactgcccacactctcataagaagagaattcttttttttcattttcttttaccgcaaatatccatgtgatatctgtttttttcaatgcatacgcattatcccattcccgtggaatttcaagctgaaactccagccttcctttctgcccgcttttaaattttccaagagatctcgcctttgcaagttcagcagcatcaagagttcctttataaagaatttttttgttttgactgatttcaaaacgaacttttttcaacatattcatctgttcttctgatcttccatccgtattcgtctgaaaaaagagttcggcttcctgatctgttgtgtttgcaatctgaacagcatccttcagtatatctcctggcatggcagattcaaggtttgtaaaaaaatcatccggtacagcaatcaatttgtgtgcttttccattaaattctacagataattttgtattgccttttttacaggtcaatgtaccatcctgctcatgcacacatttctgtatcacctgatttccccatggtgacattgcactgaaatccggtttgaaattagcagcctgaatcgcatcagcctgaatatccactgcaattttctgttttgcatgttcttccgtccaggtatctgggattgaaatattctgaaacagatctgtgctctcctgttttttcaatactttcgtgtaataataatattctccacgttttacccattcacctgagattcctccaatgttttcatctttcaggcgttccagttttccgttttccccggcatatgtgattctggccctgatccagcagggaagtgcattgtttttaattctcggtattttggatatcgtctgaccgggaaccacctccgatggctgcgtatactttacctcgccctttcccttcctggcatattccgaaatagatatactgacatctcccacggaaatatgattcactacatcaagcctgtccgaaaaagatgcgaataccgccgctgctgaaaggatagccgtcaaaagaaaacctgttatgatttttactgattttctcatattttcacctgccttttataattcaccagtataatactcccaggctttctgataattatcaaacggtcttgcttctaccgattcctgatatacctgtatttggaattcattcaacagtttccagtattttttttcaactctggcatgatcaataagaaatcctgtgcaaagctgtgttgttgactcgccttccctgaggatctttttataataataaaatccatcatctccgtaaatccaattttcgctatctgtatttttcatagtaacagcttttccaatatcgctgtttgaatatccgacagccacacgtacataacagtctgtaccggtctggttctgtccagaaggattgtttgacacccatattttcttggctatgtcaatatccttatccggaacgatcgtgggtggattcggaaagtcctctccaatttctgatgaaatatttcctggtgtcacaatatttacagccttatcatatgcagactgataagcagcggttccctgcactccgacaaggactcccagcaaaatccccataccggcaaatattctttttttgcctgtcatatgttatcacctgctttccacattattattctgtaacttgtcccggctggtttttgttctgatctacatatttctgatatgcacttcttgcctgttcaaccacattctcagcatcacctccggtgtaggatgcctggattgcataagctcttaccggaatttccaactgctgaccatccagctgtccttcaatgatattcaggaatttcaccgtgtcaaatagcgattctgttgtttcctgcggtttgagaattttattatacgcaaaaacatatacctgcttgtttccaaccttctgtgaattcagttttgtccagctggcttttgactgaaatgaaaaaagttcctgtactcttttttctagccggcttccattatctgccgccgcaatcacatttgctgtcggtattgaaacttccagatatgcataagcatcattaattccggtatttttaatccttggatctttactgattacctttcccggctctatctttttatggtcatcaggtttccagttatcttctgtcagttccacatctacctttcctactgtaaactgattggaaaccttatcatagtctgtcagatatgcggatactccaccaactgaagccagacataaaacacctgtcagaagtaaaatttttttcatgttatttttcatagattctttctgcgctttttctgctgcgctctcctttccattgtataagcaggaaaaacatttcctgtaagatcatgactgtcagtattccaaatatcgttctctgtctgacaaatactgctgcataaccaagacagggaaacgaaaatatcactttacctataatctgatccgcagtcacaaccgtcggatctgccctattgtttgcatcaccttttgttacatatcctttgtgttcttttcggatcactctgtgtgtcactctggtttcaccgacctgataagtaacaatatcaccaatttccggtcttcgttccttcgtatccgtaaaaacgattcctcctgttctcagtaccggctccattgaccctgacatgatcgaatcaacagaaataccaatctgtggaagaagcagtaacatcacacccaatatcccgatcagtgtaaaaaaaattcttccggctttttctgccgttctcatatttctcctttcctgtgttattttgtaaatctaaaatggattgtttgcagatctgcatgaattgataaaaagattgtcttaagatgcctttatcttatgctctgtggcattaaatgtcaataaaattcgttcgccatattctgacagaagatagaagaatataacaaaaaacgacatgtccaactaaaattgaacatgtcgtttctataatcgtatttaatacgtgaacctcaaactccgttacactacgtttgagtatcgaaaattcgttacacgaattttcttagttgttgatcagtttgtcttcgccattccagctgtacagtttacggatttcttcaccaactttttctgacggatgttcagaagcaagttttctcattgctttgaagtgaacctgtcttccagcgtcagacatatcaagcaggaagtcttttgcaaatgtaccatcctggatatctgtcaggatctgtttcattgccttctttgtttctgctgtaacgatcttcggtcctgtgatgtagtcaccgtattcagctgtgttggagatagagtatctcattcccttgaatccagactgatagatcaggtctacgatcagtttcatttcatggatacattcgaaatatgcatttctcgggtcatatccagcttcgcaaagagtttcgaaaccagcctgcataagtgcaacaacaccaccacagagaactgcctgctcaccgaagaggtctgtttctgtttctgtacggaatgttgtttcaagaagaccagctcttgctccaccaatagcaagaccatatgcaagtgctctgtcaagcgcttttcctgtatagtcctgttctactgcaaccagacatggagttccttttccagcctgatattcgcttcttactgtatgtcctggtgcctttggtgcgatcatagtaacatctacattctttggtggaacgatacatccaaaatgaatgttgaaaccatgagcgaacatcagcatgttaccctcttcaaggtttggctcgatgtcttttttgtacatatctgcctgtttttcatcattgatcagaatcatgatgatatctgcctgttttgcagcctctgctgctgtatatactttaaagccctgctcttcggctctcttccaggacttacttccttcatacagaccaataatgacattgcagcctgattcttttaagttaagtgcatgtgcgtgtccctggctgccatagccgataattgcaatggtcttaccatccaataatcctaaattacagtcttcctggtaaaaaatcctgtttgccatctttgtttcctcctaagctatttgtaaaataatatttatcgttaaagggctgtaccccttagcaaactaaaaacagtatgtaaaatatcctacaggaattttacatcactggcacctctggaaagtcctgtgataccagttcttgcaagttcaagtatctcatattcaccaaggagatcaataaaagcacctaacttactcttacttcctgtcatctcaatgaccagcgaagtcttcccaacatcaatgacattggcacgaaaaatatttgcaatagaaatgattccctctcgctgctccggtctggccgcaactttgacaagaaccagttctctgctcacactgttatcaggctcaagaaccttgatgtctcttacatcaaccagcttcgcaagctgtttggtaatctgttccaaaatcatggaatcaccactgcatacaacagtcattctggaataacgttcatccgcagtcacgccgactgtcaggctgtcaatattataacctctgcggctaaacagtccggaaatacggctcagtacacctgcagtgttatctactaacagggacaaaattctcttatgcataacgcacctgctttcaacactttaaacttgtaaacaattccattgtaaaattgtttgcatgttttttattatagcaacattaaatcgtttgtcaacgaaaaattttgtatacattgcatttttttgacattttatgcatttttatacaagatatttttttcgtaagacttcgatgtttttgggattcatataaagagcctttttcataaacatatccatggaaccaaaatctttttttattgtttcaaatacgatatccagatactcttccttgactctgtaaaacaaacgtatcttatccatgacctgattgtccacgatcattttggtttcaagaaaacgaatcatatattccatttctttatccagatacatgtttgttttcataaaatcctcgtaaatcgtttttttcggtactcccaatgcgcagagaagaagagcggttcctacaccgacacgatctttacctgcactgcagtgccagagcacagctccctcattctgatgcagaagtacatccagaaaacgtgcatactgtttgatgctgtattcatcatgaaccaatgattcatattgcttcagcatgaattcttcaggaatttctttaaaattcctcagaagttctgtcgggcttcctgatctggtaattcccagtgtttcctcatcaacgatcggaatctcatgatattgtacaccctcaataatagtatccggcttttccagacattccatccgggttctgaaatccacaaccgtagaaagatgatattcatgtgtcagcatatcttgatccgtaatagatatatgatacagacttccgctacgaagaaggcgtttcggcagaatatgtctgccatcctctgtttctaatgcaccaagatctctggtattcggaagactttgcatcggaatccggcttccctgaggaaaccctgttaccatctgaggattcagggcccgcataagctgtatacagttctgtatctccctgtccgtcatctcaaactgatatcttttctttcttcttgtaatgatcaccagtgaactggtactgtattgcttctgtgccccaccttctacgccttcttttcgtttgtatgcccagatgatatctttacacggcagataattcatcatcatatgtttggaaaaaataaagttgccatcctctattcttattttcccgtatttcataatctctccctctatataactctactgtacactgtatttacactgctcagataagtccaagttttgtaagcccgttttgaattccatagtgaaacatatctgttgtaacataatctgccagttccctgattttaggcgaaccattacccatagcaacttttgtggacgcatattcaaacatagaaaggtcattgttgctgtctccaaatactacggtatcttcccattctattccaaagctcctgcacaccgctgcaattccgactgctttattgcatccctttggaaccagttcaatcgtagttccgacaaatgcgttattttcatggtgaatcacatcatagtatggagacagttctctgcaagcctgatccgcatcacatccgtcctgcatcttggcactgatcttattgatatgcatacagtgttcattgcctctgatcggacgccattttggtccaagagcttctgtgatcagatccgcataccagtttacctctgtggtatattcatctttgtcataatacatataatctgcaccttccattactggaatcagtccatattttcgaagaatctccacagacttttcagctacttccggcgtcatttcattgttataaagtctttttccatctttttcaatcgtagcaccacatgcgctgatcatccctgtaaatggaatccgttcaagataccacggcacaaatgcacggcttctgcccgtacacagccatgcttgatgcccatttgcaatcagtttcttaattgattctatcgcactgtctggtactcctttttctatatcacagattgtcccatctgcatcaaaaaaaactgcttttttatcgctcatcattctgtccttcttttcgttctgccatttcttctgcataatatttcatccaaaacttttacgcaaaaagttcttctgctgctctgaccagatattcagtatccttcacaccggcagtctcatagggtgaatgcatggccagctgaggcagaccgatatccaccgtattcatcggaacctgcgtattggaaatatttccaagagttgatccccctgcaatatcagaacggttcacaaaggtctgatatggtacaccagcttttgtacacagctccttaaatatcgctgcagatactgcatctgtacagtatttctggtttgcattaaatttaatgacaattcccttgttcagtaccggatgattggtcggatctgtcttatccgtatagttcggatgaagtgcatgtgcattatctgcagaaaccataaaacttccggccagtgtcatcaggtattcttcgtaagttcttccaagtcccatattgatacgaaaaagcgtatctttcaggaatgttgacgcagctccctgctttgttccgcttccgacttcctcattatccatcacacaatgcactgcaattgatccataattctgcgcacgaagcaatccttccatggaagcaaatgcacactgcagatcatccagacgtgcagatgaaacaaattccctgtccgcaccccagacagttcccggcatgcgattatataaaaacagatcatgactgataatgtcttcctttttgatgccaacctgttcagcaatgatttcaagcaatgtccgatctgtatttcccgctgcaaataatggcagaagatctttctgtggattataagacactccattattcgcttcacgattcatatggattgcaagatttgggatcattaccaggtcacgttttatatttaccagtttttctttcagtccgccatttctgcggatgatcactcttccagcaaccgaaagtggtcggtcaaaccatggtgccatcaacattccgccatatttttccacatttagttttacataactgttatccacttttatttccggattttccttaatcttaaaagatggtgaatcgctgtgactcgccatgatatgaaatactctggattccttttccgggatacagaaagcaatcagagcagaattatttctggtcaccagatattttcctcccggaaccagcttccagtattctttttccgaaagcacttcaaatccattttctgttaatctcttctgcatttcgtccactgcctgaaatgctgttggacttttctctataaaatcaagcagtttttctgttgtttctatgtacatctattacaactcctttgaccggtatccggttgtatttcataaaatccggctacgttcttgataaaaaatatatgcattaagattatacggtatatttttttctatggcaacgaaaaagaggcagtttgtcaaaaaccacctcttttgaagctttttcgctctattctttatacaaatttataaggccttgattcttctaagtgcctcctgtgtattctcatagcttccgaacgcagtcagtcggaagaagccttcgccatgcgctccaaagcctgaaccaggagttcctactacatgtgcattttcaagaagataatcaaagaaatcccaggaactcatattgtttggtgtcttcagccagatatatggagcatttacgccaccggatacagaatatccagcctctttaagtccgttatagatcgtatgggcatttctcatataatatgcaacctgctctttcagctgtgcttttccttctggtgaataaacagcttcacctgcgcgctgtacgatgtatggtgcaccattaaattttgttccatgacgtcttgcccacagatcatgcagtgcaacgccttctcttaccagatctttcggaacgaccgtaaatccaaggcgaacacctgtaaatccggcatttttggaaaagctgcgcagttcgatcgcacaggtgcgtgcaccttcacactcataaatactgtgcggaacattttcttctgtaatatatgcttcataagcggcatcgtaaatgatcacagaaccattttcatttgcataatctacccattcctgcagtttatcttttgtgattgctgcaccacttggattattcggaaaacagagatagatcagatccggtgtctctacaggcagttccggaagaaatccatttgattccaggcaaggcatatagatcacaccatcaaagttttcgtttttcttattataatcaccggtgcgtcctgccatgacattcgtatctacatatacaggatataccggatcgcagactgcaactttgttctctgttccaaaaatttcctgaatatttccggaatcactctttgcaccgtcagatacaaagatttcatccgcactgatctggcagccacgtgcctcataatcattttttacgattgcacttcttaaaaattcatatccaagatccggtgcatagccatgaaatgtctctgcatgagccatctcatctacagatttgtggagtgcatctatgatcgccggagccagaggctgtgtgacatcaccaataccaagacggacgatctgaacatccgggtttgcttcctgataggcagctactttttttgcaattgtagaaaaaagataactgcctggtaatttcagataatttttattaaccgttaccataatatttattctcctgtaatttactgattttttcttttttcaacttctttgacaagtgcctcgcgtactgcatccggacttgccttacctttcagttcgcgcatcatctttccaacaaagaaaccaaagactttttctttaccgccaagcagctcctcaagtggtcccgggttctcatccaggatcttctgaagagtatcattgagcagaccggtatcttcaacgatcttcagaccatgttcctcaatgtaacttaccggatcaatatcttcttcgaaaactttttcaaaaactttctttgcattctgtgcactgacttctttcttttccaccatctggatcagatcagccagatgctccggtgtaaaggaaactttttccacatccagagctttatccttggtcagacggagaacttctcccataaaccagtttgctgcttttttcgggctgccgcaaagttttgccactttctcaaacaacatggacagatgtctggattccgtaaggattcctgcatcatatgccggaagatcatattcagactgatagcgaagctgtttttcttcacgaagttccggctgtgattcacgcagctcttcaatccatgcatcggagatatggattggcggaagatccggatccgggaaataacgataatcttttgcatcttctttggaacgcattgcatgagaagattctttgttgtcatcccagcgacgtgtttcctgtacaacagctctgccctcttcgatcagttcgatctgacgttctctttctccttcaatcgctcttgcaattgctttgaaagagttcaggtttttcatctcagttctggttccgaacgtttcacttcctacctcgcgcacagaaaggttgacatctgcacgcatagatccttcctggagtttacagtcagatacaccaagatactgcatcatacagcgaagtttttccagataggcaataacttcctctgaacttctcatatctggttcagatacgatttcgatcagcggaacaccacttcggttataatccacaagggaacagtcttcccattcatcatggatcagtttgccggcatcctcttccatatgcatctcatggatacgtacctttttctttccggcagatgtctcaatctctacccagccatcatgacagattggcagatacagctgagaaatctgatagttctgcgggttatctggatagaaataattctttctgtcaaatttgcaatactgattgatctgacagtttgctgcgattcctgctttgagtgcaaattctactactttcttattcagtaccggcagagaccccggcataccggtgcagaccgggcaagtatgtgtattcggtgctcccccgaattccgtggagcatccgcagaaaatttttgtttttgtcgcaagttctacatggacctcaaggccaatgactgtttcatactgtttcatgcctttttgcctcctttcgccggagcagggaaagcgcccctcactgcttcataagcagctgctgcacggagaatcttatgttctccaaaacagtcaccgatcatctgaataccaatcggcattccagccttatcctgaccacacggaactgtgattcctggaaggccgcataagtttacggcaaccgtataaatatcgccaagatacattgcaagtggatcttggagactctctccgatcttcggtgctgtatatggagcagccggagccaggatcacatcatatttttcaaatgcctgatcaaactcctgcttaatcagagcttttgtacgaagtgctttcagatagtatgcatcataataaccggagcttaagacaaacgatccaagcatgatacgacgttttacttcttcaccgaaaccttctgttcttgtctttttgtacatatcatgcagcccttcatattcagctgcacgatatccatattttacaccatcaaaacgttccagattagagcttgcctctgcactggcaataatgtaatatgccggaatcatatattccatcgtctctacagagaaaaattcaacgattgctccctgttctgtcaatgttttcagtgtattcatgaaagattctttgacttccggatcaaggcccctggcaagaaattctttcggtacaccaaatttcattccaagaagctttttctcttcaatgctctttgaaaaatcgagatctttgcgatcaagagatgtactgtctttcggatcatgtccggaaatcacttccagaagtgccgcacaatctgctacattttttcccaccggcccgatctgatccagtgaagaagcataggcaaccagaccataacgggatacggttccatacgtcggtttgattccagtcacaccgcagaaagaacttggctgacggatggaaccaccagtatcagacccaagtgccataaacgtttctccagccgctacagcagcacaggaaccgccggatgaacctcccggcacatgttccagattccatggatttcttgtaactccataggcagaagtctctgtagtacttcccattgcgaattcatccatgtttgtctttccgataatgatcatccctgctttttccagacgatcaattacttctgcattatactgcggcacataattctcaagtatctttgatgcacaggtcgtttttttaccttttatacagatattatccttcaccgcaatcggaacaccggccagcggtcctgtatatgttccatcctgaattcctttttctacttcttttgcacgtgcatatgcttcttttttatacgtatcaagatatgcatgcactttatcttctttgctctcaatctggtcaaagacttccttcacaccatccaggatgctgacttcccgctgtctgatctttgccgccagctccagagctgtcatcgattccagttccataatctttctcctctatatgaattccctttcattatccgatagtcttcggtacctgatactgtccttcttttgcttttggtgcatttgcaagcattgcttctttgttatccccgtttgttaccacatcttcgcggaaaacattctgatcaccaaagatatgagacagtggttctactccatctgtatcaagttcatccagtttttctacataatccagcatcttctgcatgtcttcttttgctttttccttagcctcatcgctgagagagagcttcgccagaatacatacattttcaattgtttcatcatctatgatctttgccatttttttttcctccctgcaaacagttacggttccagtctgttcagatctctcgggaacagacatgcctcacggacattttcctcaccaagaagctgcatagtcagacgctccagaccgataccaagtcctccgtgaggtggcataccatgtttgaatgtatccagatactgttccataccttcttcttccatgcctcgtgcagtgatctttgctttcagctgattgtagtcatggattcgctgaccacctgttgtaacttccagtccatgaaacagaagatcaaaactcagtgtgaatttatcatcctgtggatcatccattgcatagaatggacgtttcttcgacggataatgtgtaacaaacacaaaatctgcatcgtattcttctttgaaatatcttccgatcaaagcttcttcttccggttccagatcatatggattgcggatcttacgattatatttttcggaaaccagttccttagctttatcaaaacgaactgctggaatctgatctacttttggaagctgaatcttcaggatctgaagttcttttgcataatccttcttcagaagttccattgcatactgaagaaatcccgtctccatacccataatgtcttcaaatccatcgatataacccatttcaaaatcgagactggtatattcgttcaaatgacgtttcgtgttatgtttttctgcacggaataccggacctgtttcaaataccctgtcaaacacacccaccatcatctgtttataaaactgtgggctctgtgccaatacagccggtttgtggaaatagctgaatttaaacaggtttgctccaccctcggcacctcttgctccgatcttaggtgtatgaatttctgtaaagccctgctcatagaggaaatcacggaacgcacgtaccagagcttcctgaatcttgaatttagaacgctcctgaatattacggagtgcgatcggacgtaaattcagttttgcctccagagatgtatttaatttccatttatcaattgccagcggcattggttccgccggtgatgaaagaatctcgatctcctgaacacggacttctcttccatgaggtgctcgttcttcctcatggagaattcctttcacacggagagtcatagcctctttcagatcatgaatggaaagatttgctttttcattttctacaacagtctgaaaaagtccctctcttcttctcaggatcacaaaagccacatcgcccatattacggatgctgtgaacggctccttccagaactacttcctgatttaagagagaagtaccagtcagttcatcccactcggttacttcttttttgcaaataccgttcaaaaactccatttcctcatcctccatatatctagtcttttttatttaactttcgtataacagcatcagaagcatctgtgctgtttctaccatattggttccggaatccatacttgatttctggatataccggtatgcatcgtcctcactcaggtgatttcgctgcatcagcatcatttttgcattggatatataattctgttctttctcggaacgaagctttggtttctttttctctttgcgtcgcttacgttcctgctgcataagaatcatatttaccgtattgatcaggtcactggctttcattggcatttctactgacagaatcgatggtggtacttcacatatcaccctcgcagacgccagaagcagcatctcgaaatcccttggcatacactctgccagatccagataattcatatcaggaagacgatgcccacagatcaaaacaccatttcctaattcagatgcgctggaaagagcattcgatgcagtactgcatacagaggctaccgctaatccgtggcattccagaacactgcggatttttctggcatcttctattttgggtaatgcaataacaatgctgctcataccagtgtctctcctccttcagacctcatacgtttctcctacaagaccacatgcttacaggcgatacagatattctgcaatttcccagtcagttacctgctgtatatatcgcagccattcatttttcttggctgcaacatactgtttgcagaactcttctcccagcacgtcctttacccatgtactttcctcaaaatagtcaattgcctctttcagcgttgacggaagatgctccgcctgttgtccctgcattgcaaggtttgatgatttcgtcggcgtgatcttgtttttgattccatccagacctgctgccaggcagattgccagaacaacatacggattcgcggaagtatcaggacttcgaagttctactctgattccttcgcctctggtaactggaatgcgaacaagtgaattctgattattctctgtccaggtaagttctgtcggagcatcatatcccggaacaagtcgtttgtatgaattaacgatcggattcgtgatcagtgccatttccttactgtgtgcaagcaggcctccaataaaataataagcctcctggctgagttctccatgatttgactgactctcaaacacattctttccgtctttaatcagcgaaaactgaatatgcattcctgatccatttacttctgcctttggtttcggcataaatgtcgcatgaaggccatgtctctttgccacaatacgaacagccatcttaaaagtagtaatgcagtccgcaatcttacggatctcgccataacgaaaatcaatttcatgctgagccggtgctgcctcgtgatgagaggattcaacttccattcccatatcttccaatgtaagcaccatatctcttcttgcattttctccaagatccagcggactgatatccagatatccggcctgctcgtgtgtcaccgttgttggatttccattatcttctgtatggaacaggaaaaattcacattccggatcaatgtagcaggtatagccctcagcctgcgcttttccggcaacattttccagaatatatcttggactgtttttgtatggcgttccatcaggaaaatacagatcacagatcattcgtgccacttttccctgctgtggacgccacggcaggattgcaaatgtatcaagtacaggtctgagatacagatctgcatcttttaatccggaggttcctgcaatctgttctccatctatcacacactgattattcaacgcccgaggaagttcccgagcggttacagcgatatttttgattgccccaaacatatcggtaaactgaaggcggataaattctacgtcttcatcctcaaccatctgtaatatttcctctctggtataattccccataacattctctccttataatttaaaaataaataaaaaaggggcgcactttcggagggttaccctccaaaagaacgcccttgttcatgcaggtattatagcaacctgcatgatctttgtcaactctctttttacagatttgtatatcccatcagggactcatcaacagctcttgctgcctcacggccctcacggattgcccatacaaccagcgactgtccccggtgcatatcgcctgccgtgaagactcttggtacagaagtttcataagcttctggttttgtttcaacgtttgtccgtccggtaagtgctactttaaatgcatctgttacatacttttggcttcccaggaatccagctgcgatcagaaccacatctgccggaatgacttcttccgttccttctaccggaaccatcatcattcttcctgtcttttcatctttctgactttttagtttaacgatcttcgccttgcagacatttcctttcttatctgcaataaactccgtaaccgttgtctgatatacacgcggatcatggccaaacactgcaattgcctcttcctggccatagtccgttttgaggattctcggccactcaggccacggattattcgctgcacgttctaccggcggcttcggcatcatttcaagctgtgtaacagattttgctccaaggcggatacttgttccaacacagtcattaccggtatcgccaccaccgatcacaagtacatgtttatcttttgcaagttcatatggcgttttttcaaaattggaatccaaaagtgtcttggtgacttttccaagaaaatctacagcaaagtaaataccttttgcttctcgtcccggaactttgatgtctctcggattagatgctccacatgcaaggatcacgcggtcatatttcttaagaagttcttctgcagtgatatcttttccgacattggtattcagaacaaacttcacaccttcttcttccatcagatgaattcttctgtctacgacagatttttccagtttcatattcggaataccgtaacggagaagtccgccaggtctgtcacttctttcataaactgtaacactgtgtcctcttcggttcagttgctgtgccgctgccagaccggatggaccacttccgactactgcgatcgtctttcctgtacgaacgcgcggaatctgtggttttacccatccttcctgccacgcagtttcaatgattgctctttcattttcttttgtagataccggctcactgtccagattacaggtacatgccgcctcacaaagagccggacacactctggaagtaaactctggaaaactatgtgtcttggaaagtcttaaatatgcctgtttccagtttcctgtatataccagatcatttgtttccggtacgaggttatgcagtggacagccggaagccattccattaagcatcatacctgactggcagaaaggtacgccgcaggccatgcagcgcgccccctgtgttttctgtttttctttgctgagaggagtccggaactcattgaagttggcaatccggacctttggcggcagcactctggctgtctctcttttatactctaaaaatcctgttggctttcccatgtttcctcatcctccttaatgctttgctccaatgctttcataaaatgcttccatctgcgcctgttcacttgtcagtcctttttcttccagtttggcgctgagtgtgatcatcttcttatattcatttggaatcagtttcttaaagtgcggcagataatagtcaaagtcatcaaggacttttgttccaagtttagaaccggtagccgcaacatgggcttcgatcagatcacgaagttcttttttatcatatttattctccactttttcaatagagatcattgctttattaatattcttatacagtttattatcaacatccagcacataagcaataccaccactcatgcctgctgcgaagttctttccggttcgtccaaggactacgacacggccacctgtcatatattcacatccatgctcaccgacaccctcaacaactgcataggcacctgagttacgaactgcaaaacgttctcctgcaacaccgttgataaaggcataaccgctggtagcaccatacagagcaacgtttccgatgatgatattttcttccggtttataagctgctttttcaggaacttttacgatcagcttaccacctgacagacctttaccaaagtagtcattactgtcaccggtaagattcagggtgagtcctttcggaataaatgcaccaaaactctgtccgccggcgccgtgacagttaatcacaatcgtatcatccggaagtccggttcctgtctgtctggtgatttcggcaccgagaatcgtaccaaaggtacggtctgtatttgtcacatccacatccagttcgacgtgttctgcttttgagatagctcttgcacattttttaagaaggactttttcatccagagttttttccaattcaaaattataaacagcctttggatcaaaggtaaccttttgtccgtttcctgcatatggattattcaggatcgcactgagatccagtttgcctttatgcggttctgctgcgactgcctcagcagactgtctgagaagttccgtatgtccaaccatttcatccacagtatgaacaccaagacgtgccatatattctcgcatttcctgagctataaatctcataaagttttctacgtactccggttttcccctgaaacgcttacgaagctccggattctgtgtggcaacaccgaccggacaggtatccagattacatacacgcatcataacgcatcccattgttacaagaggagctgttgcaaaaccaaattcctctgctccgagaagcgctgcgatcacaacatcacgtccgctcatgagctttccatctgtctcgatacgtaccctgttacgcagaccattcataagaagtgtctgatgtgtttctgcaagtccaagctcccatggaagtcctgcattgtggatcgagcttcttggagctgctcctgttcctccgtcataaccggagatcagaacggtctgtgcaccggcttttgcaacaccggctgcaacagtaccgacaccagcctctgaaacaagcttcacggaaatatccgcatatacgttagagtttttcaggtcatagatcagctgtgccagatcctcgatggaataaatatcatggtgcggcggtggggagatcagagacacaccaggagttgaatgacgggtctttgcaatccacggatatacttttttagccggaagatgtccaccttcacctggttttgcaccctgggccatcttgatctggatttctcttgcagataccagataacggcttgtaacaccgaatcgtccgctggctacctgtttgatcgcagaacaacggtcgtccttacttcctgcagatgcaatacgctctgcactttctccaccttcacctgtattggattttccatgcagatggttcatcgcaattgcaagtgtctcatgtgcttcctgagaaattgaaccataagacatcgcacctgtcttgaatctcttaacgatctcatcgacactttcaacttcttcgatcgggattgctttttccggatagttgaattccagaaggccacgaagtgctccatggctttctttgtctaccagtgcagtatactgtttgaacagatcatagctgcctgtccaggtagattcctgaagcagatggattgtctgcggattgtatttatgctcttctccctgacttctcatcttgtgtgcacccacactgtccagagtaagatcggtatcaaggccgagcggatcaaaggcttctgaatgcagtttttctacattatcttcaatatcttccagagtaattccacctacacggcttacagtacctgtaaagtacttatcgatcacatcctgagaaacaccgattgcctcaaatatctgtgaaccctgataagactggatcgttgagatacccattttagatgcaatctttacaataccacttaagactgcatgattataatcttctacagctgcataataatctttatcaagcatgcgattatcgatcagttcacggattgtctcaagtgcaagatatggattgatcgcactagcgccatagccaagaagtgttgcaaaatgatgaacctctcttggttctccggattccagaatgattgcaagggaagtgctttttttcgtttttacaagatgctgatgtactgcggaaacagccaacagtgacggaatcggcatatgattttcgtctactccacggtctgaaagtacaaggatgtttgcaccatcacgatatgctttatcaacttcaacaaaaagacgatcgattgctctctcaagctttgtactcttataataaagggtagaaacaaccgcaactttaaagccttcgtgatccatggttttgatcttgagcatatctgtatttgtaaggatcggatgcatgatcttcagtacatgacagttctctggctgctgtacaagaaggtttccgtctttaccaacatacacactggtagaggttacgatttcctcacggatagcatcgatcggcggattggttacctgtgcaaaaagctgtttaaaataatcaaataaaggacgatgctgattggagagtactgccagtggagtatcaacacccatggcaccgatactttctgctccattcagtgccatatttctgattgaagtacggtactgttcgtaagtatatccaaatgctttctgcaggcgtgcacgctgctccggtgtatattcttccatacgtacattcggaattttgatatctttcaactgaaccagattgctgttcagccattctccatatggctgcatagctgcatatttttctttcagctcatcgtcatcgactaccttacctgcgacggtatctaccagaagcatttttccaggatgaagtctctctttcagaacaatcttctcttctgggattggcataacaccaacttctgaagacaggatcatgtagccgtcagaggtgatataatatcttgacggacgcagaccattacggtcaagtacagctcccatgacatcaccatcagagaaaagaatagacgccggtccatcccatggctccatcatagtcgcataatactgataaaaatctctcttatcctgtgagattgtatcattgttagcccacggttctggaatagtgatcatcactgcaagtgggagttccattccactcattacaaggaattccaaagtattgtcaagcatagctgagtcagatcccttacggtcaatgaccggaagaaccttatggagctgtcccttcagatatggagattccatattttcttctctggcaagcatcttatctgcatttccacggattgtattgatctcaccattgtgaaccataaaacggttcggatgagctctctcccagctcggatttgtattcgtactgaatctcgaatgaaccatcgcaattgcagactcataatcagggttctgaagatcagcaaagaatgttctcagctgtcctaccaggaacatacctttgtatacgatcgtacggctgctcatagatactacataagtattgtcgttactctgttcaaactcacgacgtgcaatatagagcatacggtcaaacggaagtcctttttctacctcatctggttttttgataaatgcctgcataatgtaaggcatacattctctggctttatgtccaagcacctccgggattaccggaacagttctccagccaagaagttccagaccttctttttccacaatgatctcgaacattttctttgcctgtgcacgcttgatctcatgctgcgggaaaaagaactgtgcaataccatattctctttctccaccaatatcaaagccctctttcttacaggcttttttgaaaaatttatgtgaaatctgcagaagaattccgacaccgtcaccagttttaccttctgcatctttacctgcacggtgctccagatgttctacgattctgagcgcattggcaaccgtatcatgggtctttttaccttttatatttacaaccgcaccgataccgcagttatcatgctcgaattcgcgacggtacagtccctgatcttctctccttacttcctgcatggtcatttatcctttctatctgtgacaggaataaaacaagactttttctcgtcctgtctcactccttttattttttattcctgattttgtgcctgtcggctcagtttcagttttgcatattcatctgctgcttttacaaatccgcggaacagtgggtgtgcatggttcggtcttgatttaaattccggatgtccctgtgttccttcataaaatggatgatctttgatctctatcatctctacgatatgtccgtccggtgaagttcctgcaatcgtcattcctttcgctgcaagttcttctcgatatgcattgtttacctcataacgatgtctgtgacgttcctgaatttctttctttccaaaaagttcaagtgctctggaactgtctgccaatacacacggataacttccaagtctcaacgtaccgcccagatcttctacgctctcctgatccggcatcaatgcaattaccggatgtttggttgcaggatccagttctatactgttcgcatcttcatatcccagaacatgtcttgcaaattcaacaattgccatctgcatgccaaggcagattccaagatacggaattttgtgtacacgggcatactgtgctgccagaatcataccttcggtacctctatttccaaatccacccggaaccagaataccgtctactttatgaagcatctgatccagattcttttcattcaattcttcagaatcaatccatatgatctctacttttgctttgcatgaaatcccaccatgtttcagtgcttccacaacactcagatatgcatcgtgaagctgtgtatattttcctaccatggcaatatttacagtgctttccggattgcgcaggtcattgaccatctgtgtccattcggtaagatccggtttgcgattctccagtcttaaagattccagtaccacatctgccagtttttcacgctccatggcaagaggtgcttcataaagatattctacatcaagattctgcagcacatggctgaccggtacattacagaacagtgcaatctttcctttgatttcatcagtcagtggatgctcacttctgcataccagaacatccggctgaattcccattccctgaagttcttttacactggcctgtgtcggttttgtcttcatctcttcagatgctttcaaataaggaatcagtgttacatgaatcagaatcgcgttgtcatgtcccacatcatgttggaactgacgaatagactcaagaaacggctgactttcaatatcaccaacagttccaccaacctctataatcgcaattttttcttcatcctgttccttcgctctgtagaagcggctcttaatctcattggtgatgtgagggatgacctgcacagtacctccgccaaagtctccatgacgttctttctgtaatacagaccaatagacctttccggtcgttacattcgagtttttatcaaggctctcatcaataaatctctcataatgtccaagatccagatccgtctctgtaccatcatctgtaacaaaaacctctccatgctggattgggttcatggtacccggatcaatattgatataaggatcaaacttctgcattgttacctgatatccacgtgctttcagaagtcttccaagggaagctgctgtgattcctttaccaagaccggatacaacaccacctgtaacaaaaacgtattttactgccattatcgatttcctcctccattttatatcttaaacaaaaggcgtcagaagcagacaaagtgacaattccctctatcgcttctgacgcctttgtcagataagatcttaaaatatgagatttactataccttattttttttcgtttgtaaatatgtaatttctataattttcaacatccgcagtcaatttttttgttcagttctgcttccacatccatcggatatttaccatcaaagcaggctttacataatggaaggtgacctgccattccctccaggtaatcactctgcatatatccaagagaatctgctccgatcatctcacagatttcctgtgcactgtgattgctggcaatcagctgatcattagatggtacatctgttccaaaatagcatggatgcaggaacggcggagaactgattcgtacatgtacctccagtgcgcctgcttttttaagcatacggataaggtttgcaatcgttgttccacggacaatggaatcatccaccagaacgattcgtttgcctttgaccgcagaatccagaacactgagtttcaaatgtacactggactctcgttctttctgcgttggtttgataaatgttcttccaatatagctgttcttataaaaagcaaagccaaacggtatgcccgattcttccgaatatccctttgctgccgggataccagattccggcacaccggtaacaagatcagcctctaccggataggattttgcaagtgatttaccgcctcggatacgagcatcataaatcttcactccatccatcatactgtccagtcttgcgaaataaatatattcgaatacacaatgggcatgtttaccggtactcaattctttattagactcaataccatttctggaaatcgtaatcatctctcctggctcaatatctcttataaactcagcgcccacagaggtaagtgcacagctctcagatgcaagtacataagtattatcgcgttttccaagacacaatggtttcagtccaagcggatccctgacaccaatcaattttctcggactcatgataacgagagcatatccacctttcagcttacgggcagttttgaggacagcctcttctactgttttggagtgtactcgctcacgtgctacatgaaacgcaataacttccgaatcagtcgttgtatgaaaaatcgctccgttctgaatcagctcccatttcagttccggggtattgatcaggtttccgttatgtgccagtgcaagtgtccctttaatataggacaataccagaggctgtgcattttctgctacagatgcacctgtcgtagaataacgtacatgtccgattccgagatcacctttcatattccgtatggtatcttccctgagaacttcacttaccagccccagatccttatggaactggacattaccacgctctccgtctgttctggaaactgcaagtccgcaagactcctgtccacgatgctgaagtgatgtaaggccataataaatggatggaacaacgtttcctccatccagatcataaataccaaatacaccacaggcttccttaattcctgccatcagaatttcctcccattatcaatgtttatcaatgtgaatttcacctgtgaatctatctgaaattataatagaagatggacttttgtcaacccttgtcctttcaaaaatccatacaaataaattcatttacccaaacaaaaaatttgaaatttttttcacaaaaattattgacatcctgatttttttgtgtatactacatcacataagcaacggcgctttggattagattccaaggcgccctttttgtttatctgaggataataagattaatggaatcgaaaggagattttaattatggcacagagcattcctgaactttacggcagtcttgtttttaacgacaagatcatgcgtgagaaattaccgaaagatatgtacaaagcgctgaaaaaaacaatcgagaacggcactcatcttgaacttgatgttgccaactccgtagcagttgccatgaaagaatgggcactggaacatggcgctactcattatactcactggtttcagccaatgactaactttacagcagaaaaacatgacagttttatttcccctacagtagatggacaggtgatcatggatttttctggaaaagaacttgtaaaaggtgaaccggatgcttccagttttccgtcaggcggtcttcgtgctacatttgaagcaagaggttatacagcctgggatcctacttcaccggcatttattaaagaccgtacactttacattccgacagcattctgttcttacagcggcgaggcactggataagaaaacacctcttcttcgttccatggatactctgaataaagaagcagtgaaggttcttcgtcttctcggaaataccgaagttaaacacatcaacacaaccgtaggtcctgaacaggaatacttcctggtagacaaggatctttataataagagaaaagacctgattttctgtggacgtacactaatcggtgctccggctccaaaaggccaggaaatggaagatcattatttcggaactctgaagccgcgtgtatctgcttatatgcatgatcttgatgaagagctctggaaacttggaattccggccaaaacaaaacataatgaagttgctcctgctcagcatgagctggctccggtattcgatacaacaaacgttgcagtcgatcataaccagctgacaatggaaatcatgaaaaaagtcgctgccaaacataatatggtatgcctgcttcatgaaaaaccatttgaaggtatcaacggaagtggtaaacacaacaactggtccatgagtacagatactggtgtcaaccttcttgatcctggtaaaacacctgctgagaacacacagttcctggtatttcttgtagctgttattaaagcagttgatgattatgcagatctgctccgtatctctgttgcaagtgcaggaaacgatcatcgtcttggtgctaacgaggctccgccggcagttgtttctatctttctgggagatgaactgacagaagtcctcaaagccattgaaaacgatgaattcttcgcaggacacagtgctgttcagatggatatcggtgcaaaagtacttcctcactttgtaaaagacaatacagacagaaaccgtacttcaccatttgcatttaccggaaacaaattcgaattccgtatgctcggttcttcttcttctgttgcaaacccgaacatcattcttaacacagccgttgcagaatctctgcgtcagttctatgagaaactgaaagatgttcctgcagatgaaatggaatctgccgtacatgaattactgaaacagacaatcatcgaccacaaacgtgttatcttcaatggaaacggttataccgatgaatggctggaagaagccaaaaaacgtggtctttataatctggtatccacaccggatgcactgccgcacttcatcgatgaaaagaatgaaaaacttcttacaagccatcatattttcacagacgcagagctgcattcccgttatgagatcaaaatggaaaactatgtaaaaactcttcacattgaagcaaatacactggttgagatcattcagaaagatcttcttccaagtattactacatatatggaaaaacttgctcagacagcatctctcaagaaatctgttgttccgggtatctctgtatccgcagaagcatctcttctgtccagactgactgagcttgccgaaacaatgaccaaagatctggaaacactgaaggcagatactgcaatggcagaatatgaggttgacaaagatcttctcaagagtgcaaaactctaccagagcgttgttcttaccgatatggaaaaagttcgtgtttctgcggatgcagctgaagcactcattcctgattctattcttccatatccaacctatggcaaactgttattctccatctctgactgagaataagagaatacattgataatttcacaatggtaaaaccgggggatgtcattatgaacatgaactacttcataattcattatcgatttcctcatccattaatcacacgatacgagacatcccctgttttacatatacatttgattcgtaaaggcgcgagaatgatttttcatcattcccgtgccttttcaattttattttaagaaactgttaaactgctaaactttttaagggaaagagaggtaactttatggactattcatcagtaaacacaatctgggtacttttaggtgccgcacttgtcttctttatgcaggcaggctttgctatggtagagactggctttaccagggcaaaaaatgcaggtaacatcattatgaaaaaccttatggacttctgtattggtactcctaccttctggatcgtcggatttggtatcatgtttggagccggtaatggatttttgggaaagattggcggtattgccacggaagctaattatggttctgcaatgcttcctgacggtgttccgttctgggcatttctgatcttccagactgtattctgtgcaacatccgctactatcgtatctggtgccatggcagaacgtacaaaattttcttcctattgtatctacagcttcctgatcagcctgatcgtttacccggtatctggtcactggatctggggcggtggtttcatcagccagatgggatttcatgattttgctggttcctgtgccgtacatatggttggtggtgttgcagcctttatcggtgccatcatccttggacctcgtattggaaaatattccaagagcggtaaatcaaaagctattcctggtcacaaccttaccatcggtgctttaggtgtattcatcctctggttctgctggttcggatttaacggtgcatctactgtaagcatggaaggtgatgcaatcgtaacagcaggtaagatttttgtaactaccaaccttgcagcagctgttgctacagttactgttcttatcatcacatgggtaagatacaaaaaaccagatgtttctatgtcactgaatggatctcttgcaggtcttgtagctatcacagcaggttgtgatactgtttcacctacatctgctgctatcattggtatcatctctggttttgtagttgtattcggtattgaatttattgacaaagtacttaaagtcgatgacccggttggtgctgttggtgtacatggtttaaatggtgcattcggaactctcgctgttggtcttttctcagatggtacaggcacagaatggaaaggtcttcttgttggcggtggattccatggcttcggtgttcagtttatcggtatgctcattacaatcgcatgggttgctgtaactatgaccatcatcttccaggcgatcaaacatactgttggtctccgtgtaactgctgaagaagaaatcgaaggtcttgattccaaagaacatggtcttacaagcgcttatgatggatttgttgtacatgatacaatgacagttccgacacctatgggtgttgccaaaaaatctgtttcttcaaatacttccgcaaatgttgcacctgctgaagttgttgacaccattcctgaccttccaagagaaggcgtacataaactgacaaaagttgttatcatcacacgtcagagcaaacttgaagaattcatgcatgcaatgaacgaaatcggtgttaccggtatcactattacaaatgttatgggatgtggtgtacagaaaggtgcccgctcctactaccgtggtgttgaaatggatatgaacctgctgccaaagattaagattgagatcgttgtcagtctggtaccagtcaaaacagttattaacactgctaaaaaagttcttcataccggccagtatggtgacggcaaggtattcgtatatgacatcgaaaatgttgttaagatccgtaccggtgaagaaggattcgaggcacttcatgacacacagcctcttgaatgatttctcggtaaaaaatatattgatccccctttttagcactaaaaaacagctcttcaactgaagggctgtttttctatgtttatgattatatttcttctttactattcttctcgggtaagctttggaagattccatctgtaatgtgccgcaaggtatctgaccaatataactactgctgacgctcctaccattgacaccactgcaccaaaattccggtacagcaccacacagacgatcgcaccaacaattgatgcacaggcatagatatgcttcaccagaatatatggcggcactcctgccatgatatctcgcagcaaacctcctccaactccggtgatcgttccaagaaacaccaacaggaacatataattcacatagccatgtgaaattcccgtattcactcctactactgtaaaaatcccaagtccgatggaatccatgaccagcatgatcttgtcgtaagtttcccggttatgcccctgcagaagttcttttttcagatacaagatcagaaagaccacacacgatgtaattgtcgctaccagtgtatagattggattctggaacattgccggtggtgcgattccaagaatcacatctcttatagctccaccacctacggctgtcgtaactcccagtacgatcacaccaaaaatatccattgcccggtccactgcaaccatcgctcccgaagctgcaaacgcaaccgttccgaccatttccataataaaggtaataagctgctgataatccataattttccctctccggtttcccctgttctatgaaatttcattatactatatttttttattcttgcaattacatattacaatatttttttatccggcgaattttttttgtatacaaaaagagcggtacaccccccacctcctttcagaagaaaagttgtatcactctttctgcattcatatcttatctgtccggcttacatcccctgtgattcagcccatgctttcaatgcatttttgtccgcactgccgaaccgttttccttctttccagtccgcattcggtgcacatttcttcaggatgctgtctgtcttacccattccacttcctccggaagttgcaaatgttgcaattttctttcctgtgaaatcataactctcaagaaatgtattgataatggtcggtgccacataccaccagattgggaatcctacaaataccgtatcatactgtcccatatccggtattttatttccaatttccggtctggaatccggattactcatttccacactgctgcggctctttttattcatccagtccagatctgctgttgtatacggaactgccggctgaatctcaaataaatctgcccctgtcacttctgcaagtgtctttgccattttttctgttactccacttgctgaaaaatatgctactaatttctttgacatgataaagtttcctccattctgtttgacattgaatttttaatttgttactatgagtatagcacttaaacctgactttaggtcaatacctttgagtaaaatataagagtaaattccggttttattttacggttttacagattatggaggaatatcatggatgttatcagtatcaaagactttcctgggatccgcattggaaatgcacagaatgtcgagggaggaacaggctgtaccgttatcctgagtgaaagcggcatgtgtgcgggacttgatgtccgcgggggcggtcctgcttcaagagaaagtgaacttctcaaaccgcttgccagcgcacagacgatccacgccgtacttctcggcggaggcagtgcattcgggctggatgccggcggcggtgtcatgcagtttctggaagaaaaggacatcggttttgatgtaggtgtgactaaagtacctcttgtctgccagtcggatctctttgacctgaccgtagccgatccacactgccgcccggataaggcaatgggatatgaagcctgtaagaatgcttatcttgacaattaccaggatggaaacttcggtgtgggcacaggagcaaccgtcggtaaatttaaggggatggatttctgtatgaaatccggcatcggaagctacgccgtacagatcggtgaacttaaagtcggtgcgatcgttgcggtaaatgcactcggcgatatttacgatcatcactctggcaggatcgttgccggtctgctcagcgaagaccgtaattcttttgctaattctgcaaaactactctatcagtcctataaagtacatgaaaacaaatatgtcgacaacaccacgatcggtgccatcatcaccaatgcacgcttcgacaaaagccagctctgcaagattgccggtatgacacataatggctatgctcgttccatccgtccggtccatacttctgccgacggcgacagtatctacgccctttctgtcggaaccgttgctgcagactgcgatatggtcggcacgcttgcagctgatgtcatgtcagaagcgatcctctgtgctgttcgaagtgcagaatcggcttatggttatcctgcgcttcgtgatcttaaattttaaattcaaaacatcaggaggttttttattatgtattctatcggaaaagtatctgaaatgtttggtctgcctgtctctacgctccgctattatgataaggaggggctttttccggatatgatgcgtgtctccggagtccgcaaattcagcgaccgtgagctggagactctgcgtgtcatcgaatgtctcaagaaatccggcatggagatcaaggatatccgccagttcatcgaatggtgcgccatgggaaaggaaacctatccgcagcgccgtgccatgttccagcgtcagcgcgaaaatatcgaagctgagattgaacgaatgaaccgtgctctcgacatgctcaaatacaaatgctggttctatgagcaggctatgaaaggtgtcagcgaagaacagcttcatgcgatgatcccggattccatgccagaagagatccaggaagcctacgctcacgcccacaagacaaaatccgcataattttttattatttagttccgtaatcccctcatttgcgcccattgtgatgcgctttaccttcgcaaccgcatcttccgtgcacatcaaactcgataatgggactgttcatcatctgccctttctctccttgtgttcctttttatcctcatacattttctggtctgctctcgccttggtgtcgcggatactctcctgctcaaaaagctccgcactgccagcggtaacagtttccataacggctataggcttttttcaggcatccggcaatttccctcaggcaccggtctccagccaaatggccgtacgtatcgttgatatacttaaaatcgtccagatccagcgcagccagaccggtccgtcatccaccagcacggaaatcatctccagaatggagattccaccaatcagaataaacgtggcaagaaacccttttgcctgtttgggattcagggtttcgcttaacttcaccagaccgcacataaaaatcaggacgaacaggttgatggcagtcagtataaaaaagtataagtcagtcacagtccttctcctgtatgtttttccttactgctcgaatctgcccttcatcttcacttcctgctcccacacagcgaccttgccgcgggcaaacaggctgttgatgttgagattctcatccagtatcagaaggtctgcgtctgcgccttccgctacacagcccttgattccttctttgccaaggagtacggccggagtgctggtcagaagctgtaaggcatcctccagcggcatgccctctcttaccagaatctggatggtacggtgcagatacttcggggacgcgtaggtcaggccaatgcactcgccctcttcgttgaagcgcggctggcttccgaacgcgtcactggacatggttacatgatccaggctcacaccttcgcggtgcaacagctcatagagcttcagagcatcggattcgacctccacatcatcggcgccggcggtgcagtcaatgtagccgccacggcgtaccagatccgcgctggcatcaatcaggccaggattgcgtaagatgtgggtcggcagcaggttcttggctggaacgtcggaatgatccagcacatagaaaatcggatccagtcttccctctccgtcacccatgtgcatggttaccagaccaggggtattgctgagtaagccggctctgcgcgctgcagtagccagcgcgatcagctcttctccgcctgggttggagcttctgtggtccgataccgctaccttcacaccgatcatcggcggaaccaggatgatatcgcgctctacacttccggtcagggtggttggcgggtaaccataggaactggtcagagtgtacacggtcatgccctcttcggtcagggcgcgagcttttgcgaccagattttccacactgcgggttacgccatcggttcccagaagtccgactaccgtggtaataccatttttgaagaattcactgagctgggattccggtacacgggatgccggaccctgctctccgccgccgcctgtgatatgcacgtgcatgtcaatgtaagccggaacaacggtctttccctccagatcataggtttccactcccggaagtccctcatatccctcaatagtatcctgcatcagaaggattttttccccctcaataaggatatctttctttcccagtttctccggtgcgtacacattcgcgtttttcagtaacttgatcataatgtcaattctcctgtctcttttttttccgcttttctatttcaaagcttctgtcagtctgtctcaaaagtgccttttaccagtgcttttccatactccaccattttctgtccacgggcaaataccgtatctaccagaaattcctcatccaggatcacaagatccgcgtcgctgcccggacggatgcagccctttttcgagaataatccgttggctctggccgggttctccccgcagatgcggatggctttttccaccggaacccctgcctttacagcatcacgcacttcctcatgcagggaagaaagccgggtaaccagaagctttgcgccgccatccggcaacggaacactcatacttccgtttccatcggaactcatggtgatctgctccatgggaacaccctcttccatacagatgcggatggcctcgcttggcttgatgcagttcgtaaagccgtcctgctcccggattccggaggtaatgtcaatatagcctccccgcctcgccagctcttttgcctgctcaaacagatgcggcgcacggtttacatgggttgggatcatatggcggggcggaatctctgtctcatccagaatgtcaaacagcatctggattccgttctttccgattcccatatggaactgcaccacaccggccttggcagaaagcatgccgcccagtctcgcctgggtcaggatccgtttcagctcatccttggtaggctgggaggaacggtggtctgacagcgcgatttctccgattccaaggactttgtcgatcaggataatatcgcgccttgcgtctccggtcatggttctaagcgggatttcgtaggaagcagtcagcatataagcgctgattccttctgtttccagcccccgcactttcgcaagcagggattccggatggcgtccggttccgtcggttcctagaacgccaataaccgtggttactccagctgtggttacatcggaaagaaatacttccggagtccggctataaggccccgcctcgccgcccccgccaatcacatgaacatgctggtccacataaccaggaattaccgtttttccatctgcagaaacaacttccaccggaacagaaagttccggtggatcgatgtgttctgccacagaaaatactttttcatctacgatcaggatatcacggattccttttggatccggatcatacagattcgcatttttaattaaaagcactctggacatcgtatttagttctcctttttcttctcatcatcgagcttggcaataccaaatccggtaaagccccagatgatcgcaaaaatccagccggtgtagcacaagattgcccatggaaggtaatccagagtctctacgccaagggtggaagccatgtaagcacctgctgcggaccacgggatcagcggtacaactacggtaccggcatcctcaagggttctggacagattctttgccgcaagcccgcgctctttgtaagcgtcacggaacatctcgcccggaatcagaatggcaaggtaagagttaccggtggtcagtgccatggtaatgcaggctgcaacggttgcggtgatcagcgcaccggtactctttgccacgcttaagatcttctggagtaccacatccagacagccagcccggctcatgatacctgcgaagcagaatgcgcagaataccagaagtgtggtactcataatgccgttcataccgccgcggtttaacagcttggttacggcctcggaacaggtctcggtgtcaaatcctgcactgtggatcatggatacattaaaaccgtttacggttgcctttaacacatctcctaacgctacgtgctgaatgaagacactctccaagcctgctacaaaggtagaaagaagcataaccggaatggttggcttctgaaacagggagccgcccagcacgatcactaccggaatgatgatcagcaggttccagctgtacatggaagaaagctggcttaataaagtagtaacggtgtcagaagtaatatctgcgcttgcatctgcgttcataccaacaatggcatataccaccagggaaacgatggttgctgggatagtggtgtagaacatatgtccgatatgctcatacagtgtgctgcctgccgcgattggagccagatttgtggtatcggacagcggagacatcttgtcaccaaagtaggaacctgcgatgcaggcacctgcggtagccggaagggatacgccaagggcgcttgcgattcccatcagggcaacacccatggttgcaacggaaccccaggaggtaccggtaacaaccgaaaccactgcctcgatcaggaacgcggtaaccagcatgaatttcgggtttacgatctggacgccgtaataaatcatcatcggaatggtaccggctgccatccaggtaccaaccatagcgccaacacatacaagaatcaggatggccggcatgccctttgcgatcttggtgcagatctcatccatcatctcatcccaggtaacgcctacacggaacgcgataaatgctgcgattgcagctaccatgatcagaagcggctctgtgctgtagccgaatacgccttttccgatggtaaggatcaggagcattgcgacgatcggtatgatcgattccgcaaaagtgggcagacgtttggcccgttctttcttttctttcatttgtagttcctccttttagcctccttcgtgacagtttcacttttatcacgacagagtattaaaaattgggcttattatatcagaaaagatgacgggccacaactaaaactttatatttttttattttttgtgagttttataattagtagtataaagaaaagcagttctgatgctactaatttttttatttagggttgtgcaaaatgtccaaacatctggacaaaaagcagaaaggaaattaatacggattctgtgcaggtcatgacactgaccaggcagttcaaggcagtcggtgtgactccacacattttactcaatacaagtcagattactactttacttaatatgataaaatctgaccgggttggaactttcctctatcgttctatcgtggagacacatcctgatattgtaggaattcctgtcatgccttccatcgaacagcgaatcggtgtcatctggaaaaaaggtaaataccagaacactacgaccgaaaaagtaattaaatttattgaaaacttctaataaaaaagagaacagctacagattatctactgctataatggcagattctgtatttgctctctttttatttactcatcccaatctctgatcgcccccggtggacaaatctctgcacaggccccacaatgtctgcatttactctgatcgatcactgccggctttttatatacgtcaatgcaatgctccggacaggctttcacacataagccacaattaatgcagtctgtatttatataatatgtaatctcttcgtccatctgtcgtatctcctttatcttatctatgtcacttacaaatgtggttacctttttgattacctatataaaatttcaaaaacaaaaaacgccagaaaccttgactcacaagactttccaacgttattaagagcaggggatgagagaatcgaactcccaccaaaggttttggagacccctatcataccatttgaccaatcccctatataagaaaatgtgactattactagtcactttctttatcaaatcatcgtatcttcaaaaccacatacatgttgacaatttagaatcaaatctgaccatgctttcgctttcgttctgaaatgcaagcattcctcactctacgtgcggcgacagccgctcgtctcagctttttggtcaagccctcaccctattagtagcagtcagctccatgtgttaccacacttcggctttgcagaaatgcaagtcacagggctcttttgtcgcagagtatgctactctgcgacattttttcatctcatttatttcacttttacgatataagtctgccactcatcatcctgataaacgacttctcccatactcttcagcatatcgttattcaactgggcgccgtacttctttcgttcacacgatcccacaaaaatatacgatatatcatactcttccaacagggacttcacatgtgcttcatctgtcgaagtataaatattctcaacatctgcgatcttggcattaatgtcagcaaggtctcctcgccacagccactcatgcacataccaacccatgatcgtcgggagaccggtcatggcggatacccgttcgtattcggaataactgtcaccgtttgcttcaagcaccacttctacatctttgacattttctttgagccacttgattccgccgacatcttccgagaaatcggtctcaagaaaggcagttgcattcagtcctttatattcagacggtttccatacttcaccgaaccaggcatgtacactgtttccgaaataaccacaggtccatacaaagagaatcagtccgatcactgccagggctttgagtatcttattctttcctatgatcagcagacggaagattgcgtagatcatagtcatcccaaacataatatatgcctgataggtcagcttaaacatcgtattggcacgggcatttccgttttcataaatatcacgtacatagacgagttccggaatcagcaccagaccgatcgcacagagtcccatgaccacagcaaaaagatccggaagtgtaactgatttcaaaagccgatacagagatctgttttctgccacttttaatttctcaacaagcagagaaatgataaacaatgcagtcagtatcgtcggcaggccccagagcaccaaaagctgatgcggaagggaatgatgctgggcaagtgcgactccctgtaccatattactgctgtcaaactgcatcgtaaacggaaggatgatcagtgttgccagtatcaggatctccgctgcctgtgccgctgtcacggcaaggatccattttacctttccttcctgtccgataatattcatgatcaggatcactccacaggtcactgtataataaatgacaaaatcccagtagtttgtccagtggaacattcccagaagggctgcagctgccaggagctgtggcatcagaagctgtctgcgccagaattcttttttctctgtattctcgagtgtgatctttgttgttcttacctttttcatccaggcataaagcaatgcaaggatcaaaagaacaaacataatatccacaacatgtgcatgcagatctccaagtacgaaggaataacatggaaattcatgaatcgttttgtcatctacatccgggttgaatccgatatatctggtcgcatctgggaaccagtaactgctgacttcctctcctttcaatttctggatccatggaatcacgcatgcataaacaacatagtgcatatttccggccacggaaactgcgattccggccagaaatcctgttacagacggcagctttttcttccatccgctgatgtttctgcccagtcggtctttcaccatctgatgcacgagtgagaatggcataataaaggcaagccctgccacaaaagtacgcatcaggttgtaggtcagttctactttcgtgcctgacagctttgtcagaaatactgcaaaatactgtccgccataatagtaattgatcttgccctcagaataccagagatctgttgcaggaagtgttttgcttcgcatcattgcttccatgaaaccataatccataaatttctctgttccataagctgccggatggaatcctgcaaaatatgtccacataagaaagaatgcaaagaaaagaagctcttccgcatataccagattaagatgtgcaaaaggaatacactcgaatccgtctttctgttcttttcggtataataatatagaaagaacagtgcagataacagtcaccgccacgcaggtaactgctgtaaatttcaatatcttcacagttaccagaaaccatgtcagaaaaccggtgatcgcgattgcggttacttttgaaaaaatccatcccttatcatcaaaacgtcgaaacattcttcctgtcaatggcatagctgccactcccagcaccagtgccagaagataccaggtccaaaaagtccatacatcgccct
